United States Patent 11,549,145 (METHODS AND COMPOSITIONS FOR INHIBITING AND TREATING NEUROLOGICAL CONDITIONS) - sequence listing, part 140

SEQ ID NO: 2523 - DNA, 164692 bp, Homo sapiens
agcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacgggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatcaaagtaaaaaacatgcaatggtgaaccttggtatctttgtctaggaatataaagaatggcttatcagtggagaccatcgacagttgagaaaagaagaagcccaaaaagtacaagaatgaaaatcgagagtgtaagaagaatgtctgttttactggcattatctaacactcagatatgcaactctttattgccaaacactgtgtgtgttagttaaggtaaaaggtgaagggaggcagaagaatggagattgaattgaattctagagctttagttctgtgtgagtttgggcccccagaagttctagacattaagtacagtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgcacaacgtgtaggtttgttatatatgtatatatgtgccatgtcagtttgctgcacccattaactcgtcatttacattacatatttctcctactgctattcctcccccatccccccactccacgacaggctccggtgtgtgatgttccccgccctgtgtccaagtgttctcattgttcagttcccacctgtgagtgagaacatgtggtgtttggttttctgtccttgcgatagtttgctcagaatgatggtttccagcttcatccatgttgctgcaaaggacatgaactcatccttttttatggctgcatagtattccatggtgtatatgtgtcacattttcttaatccagtctatcattgatggacatttgggttggttccaagtgtttgctattgtgaatagtgctgcaataaacatacatgtgcatgtgtctttatagcagcatgatttataatcctttgggtatatatgcagtaatgggattgctgggtcaaatggtatttctgcttctagatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgaggtggtatctcactgtttttaaaactcattacagagctaagtggtttttatttaatgtaaatttatatcacattacttttctactcaaaactccccaatggtatcccattaaacttataaaatttcagttttctttctggctcccaaatttctttttttttttttttttttttttttttgagatggagtctcgctgtcgcccaggctggagtgcagtggtgcaacctcggctcactgcaggctccaccccccggggttcacgccattctcctgcctcagcttcccgagtagctgggactacaggcgcccgccacctcgcacggctaattttttttttgtatttttagtagagacggggcttcaccgtgttagccaggacggtcttgatctcctgacctcgtgatccgcctgcctctgcctcccaaagtgctgggattacaggcgtgagccactgcgcctggccccaaatttctttatgactaccttctgcctttgttttttgcatatcacagtttgtcattcctccttccctctttttccctccctagtgcatttagttgaacaagccaagcccatttccaccccaggaactttgcacttgttgccaggttcctccaggtccaggtcttcacatgatgtagacattctcatctatcactttctcagaaggatgaacatgaccctttaaggtagctcttccacactccagtgactctgtcccattactctgctgtttcctcatagctcttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacgtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaaaaccatgatccaagaaccactgggggtgggacagtggagttgggatatggagaaagacaagctaagtgggatgctgcttttcgacactttgacaaagatcatccttaccattatctcctcataagatacctagaggaaaaggtgatgacattatatatatttggaagccacaagtgtggtacatatttctagataataagaatggaatgagctaacatttattgggaacttactctgtcctgagcactattatctaatttagtcctttcaatatctctaagttactattattttgtttctcttttccttttttttttttttttttttttttggtttgtgttttgagacagggtcttgctctgttacccaggctggagtgcggtggtacaatcccagctcactgcaacctccacctcctgggttcaagcgattctcctgcctcagcctccctagtagctgggattacaggcgcctgccaccatgccaccttttcccaacctcaggaataatatacttaaccaaccagcattaaactccatgcatgagtttttctcatatatgaaaagaagaaaataggccaagcgtggtggctcatgcctgtaatcccagcactttgggaggccgaggtgggcggatcacttgagccattttttgtatttttttagtagagatgaggtttcaccatgttggccaggctggtctcaaactcctgacctcaagtgatccgcccacctcggcctcccaaagtgctgggattacaggcatgagccaccatgcctggcctattttcttcttttcatatatgagaaaaactcatgcatggagtttaatgctggttggttaagtatattattcctgaggttgggaaaagggagtcttagtgaaaacaaaaggtgtattacctaaagggctcattttctacaggaaaattatggtggctagattatgttttattattctctttcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccaggtaagaatgctgggaaggtttttaaattttatttatttatttatttttgctactgcatgtgtttattataatctttgaaaatcattgttgtattacataatagagctgttgcaattatgtttgaaaagcagaagatccctggtgctctcaatcaacctgtcagcctaccttagcctcaaattatctgttttctcccctcctctgaatgaaatacatgcagggtacttatactgtcaactacttctctgaacaattgagtgactgattgaaaattacaggcagatacatttacttgttctctaagcacttgggattcaaagcaattattttagaatgcagtgttagaatagctcttatattctggcacttagtttataataatatgatgtttgtcttagagaaaatattgttttgtgacctggatatattagaagagatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaatcgaaaattaaaaggacatttttatttgaattgtaagggataaaatactgctatgggagtgaattgtgaggaaataaaatttaggaaaggaattcttaacggaaatgggagataaggggcttggtgatatgtgcatcacacaatgtggaaacctttagaaacagcgaggacccacatgagacaagtcaggtctggttgatggtggccctgccctgatgtgctctctggcctacagggctcctgtactgagtcagaacccagtttaaaaatagcattgtacagccgggcgcggtggctcacgcctgtaatcccagcactttgggaggccgaggcgggcgggtcacgaggtcaggagattgagaccatcctggttaacacggtgaaaccccatctctactaaaactacaaaaaattagccgggcgtagtggcgggcgcctgtagtcccagctgctcgggaggctgaggcaggagaatggcttgaacccgggaggcagagcttgcagagagcggagactgcaccactgcactccagcttgggcgacagtccgaggctccatctcaacaacaacaacaacaacaacaacaaaatagcattgtacctcactaatcaccaggaaaatgcacatcaaaaccacagtgagatatcacctcacacccttttctatgactactattaaaaagtgcaggatataaatattggctaggatatagagtgattacagcccttgtgcactcttagtgggaatgtaaaatggtgcagccactgtaggaaagagtatggcagtttcctcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagtatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcacttgagtctagaagtttgataccagcctgggcaacatgacaaaaccccatctgtacaaataatacaaaaattaattaggcgtgatggcatgtgcttttactgccagttactctggaggctgaagtgggaggatcacctaagcccagtagttcaaggctgcagtgagccatgatcacaccactgaactccagcctgggtgacagagcaagaccctgtctctaaataacaataattattctaataattttgaatgatgtaaaactttattaaccccaagtgttcttctacatcagtgattgtcaaaatgtgatcccttgaccaaaagcatgaggttcactagagatcttattaaaaatacaagttcttgtgtcctaactcagaattactgaatcagattgttaaggtgaggcccagccttctattctagatcctctaggataagatggtatcctagagttgggtcaattaattccccttcttactattctcacgccagttgcatcttaatgtctaaggattcatgtattcggcaaatatttaatagtcagttaccctactcgagacacttctgtcagaacggttcagagaaccaaagagcaaagctgtcgcatacttgaacgtgtatctagtatgacaacagataataaccaaacttagaaacaattatgctctaccatcatgtagcactctaaatgataatgagggctgtgaagataagggtgtgaccttacccacagaaatatggtgaggtgccatctgaacaaagatgacagcacagtgaggaagtgagcctcatggagcacaggtgaagctgagcctggtcgtggtccacgtttatgctgaacagaggtaccaactcaggagcacatgatgtaggagcaaaaagataacacatttttcataaccatcacaaggggcatggctgatgtttctataacaaagacaggttagcaagagaaaaacccagggaaaacttgagattttatgctaagttgaatgaaagaaatgaatagatgtgactaaatagaattggaatgaaatatgatctaaccgtaatcaacagacagtggcggggggactcagcaagtcctgtatttttggattcttcttgctccctcggtgtagcatttcttccctctgcatatagggcaggacacctgtcatatgaaagtctatccgggagaagggaaaaggtcagtgcgtgagctttctaggttttaaggcttgctgtaggagaggatttcagtttctttgactcacctggctgcaggacacagggcaggggattggagaagatcagaaagaccttgtttctgaggccctctcaaatctccttcagttccaagtactcagcattccaaggcactgtattttagaatactatgttctgacccccaacggtgttgaaatttccttcttttttgttttgacaagatgtgaattcatcaggaaaccagtgttccctatcttattaaagccttccaagagcatctaaaaatggtaaagcatgttggattatttttggagactagcataacaccaagaaaataaactttctttagcagttctgaacaatgaaaaacagaacagaaataaacaagttttgaacaaatgaaaggatcacaactcccaatatgagatttttttttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagatataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaagccaccatgccaggcaggattagcagttttaagaatctttgctcattagataataaaataattattccattcttctttgaatttgcagttcttagacaaccgttggagatagttttcataaactccttggtcattgctttcctttttgtcttaagttgctcataatgtatacatttaattttaaactaaaataaatataagtggtaatgtttcattttttttctcttaaggatataaactccttctctcatatatcttaggaattttaagtgaaaatgtccagttaatatagctggctaatagcagaaccagaaatgggttccaaatattgtgactgctagcccatgtgtcttgactcaatcctgcttttacttttttaaaatcactcaattgaagtataatttatggaccataaaattcatccattttaagtatacaatttaataatttttagtaattgcatatgattacagtaccattataatccaattttagaacatttcttcattccatttttttatctctagcctaggcaaacagtaatctactgaacttgctgttattttgatctatatagaagattattaactcaaagaatttttttactattaaactatatttggagaaaaaaaaacggtgctgctttcaatattcttttcatagtcaaataaccctctccttcaatcttaccacacatccaggagagagatcagtaaattgacacccaactttagtagactttagtaagtacttataaaatttaaagttatccaaacaagatcttttataattttgcacatgtaattgtttggactcagataaaattggcatagcaaaataatcatgcttcagtttgtctccagggcttccatataacataatagagagcctcttaaactcaactgcttttaggcttagaaggctgtgacagatatgagttatcagtgcatgaaatacaggaaagcatacttttctctataaactagaatcttttattcaacaacagataaagatatgttaaataaaagattttatccagctataaaaggacatgtatttataactgtaattttgatagtctgataaatctctaactttcataagaaaacaattaagagtattccttagttaaaagtttaattttgtagacattgagacttttttttttttagatggggtctcactctgtcacccaggctggagtgtagtggtgcaattttgactcagagcaacctccaccccctgaactcaaagaatcctccctcctcagccccccaattaggtgggactacagatgcataccactacacccagataactgtttgtatttttggtggagacagggtttcaccatgttgcccatgcttgtctcagactcctgagctcaagtgatctgcccatctcagactccaaagtgttgggattacaggcgtcagccgccatgcctggccaatattgggagcctttcatgttacttaaattctgcatttagtggacatatttgtaaccttgttatttcatttgcattggactgtctgctccctgagtgtaggaactgtcttctttctctgtgaatgtgtgggagtcacctaggcagaccttagtgtggagtgacgtccaatcatgaagagggaacagcatttgcaaacacacaagagaaagcatagttactttgatccctaagaatagttttacatgatcaaagaatgtcatgtaaaaagctgggtattggtaaatggtaaataataaggtacggaatagggaatatagggtactaggatgattggtataatagggtgaagagtaaatgagtgcgtgtgggtacctaacagtaagtctgaagaagtaaatgtaatagaagtggaggtaaaggaaaatattcagtaaatacatgaaatactcattaaataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacgcatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcattgacaaagaaagaactctagaaagagccagagacacagaagaacaaggaaagtgtcgtgttctaaaaccaagggaagagacatattcaaagaaatcagagggcttgccatcatcagctatcacaaagactgtataagcctttcatttagcagtcaggagagctttattaaattgtcttaactttaacagcttcactggaatgacaggcagggaaactatgtacatttctagatgtcattgaaggagtaaagtatcggaaatgagatttttaggcttcttttccaagaaaccttgctgtaaaaggaaacataacaaggaacaaaaggaaatgaatgaatgcttttttcaagcaaggtgggggcttgaatatgattgtgcattgagaagatggtatgggaaaaaaaagagacagacagacagataacagaggtgaatgtgattttcagccaagcagagtgcatgctggatctgttgtctattcccacctttttcagctcatggagcccaatattctaagataatgcaaattgctgaagacaatctttccctactctctaaggatatattggccccaatgtctaaggtcaacattagccagattgagattttacaaagaaatctcaaggtcccaaccaacttttccatatttttgggcaatatgataccaggcataacatacctcagccacaggacaaaggactgggaatagaaagattcttacaaggagagtacactttcacctttgcctgggacaatgtttggtcttttctgtcttgccatatgaactctttcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagtgcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgccacaacttaatatgtatttaagaaaatatgtttaatagaaaataggtttaaaatgaaaatatgtatgtttccatatatagagagagatggaagaatatatattttcttttttaaactaatgccatagttcaattatttaagccagacagctaaaactgcttctttttgtccaagtatatggctcacccctgtaacccagtactctttggaaggctgaggcaggaggatggcttgagtccaggaattcaacaccagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtccaattttggtgattatgaatagctactattaacattcatgtacaggattttgtgtgagtgtaaattttttatctaaattttttttttaagatcagatagtaaatatttcactcttgacaggtctcatgtattctttttttatttttatttttttagaaaaggtcttgccctgtcacccaggctggagtgcagtggcataatcacagctcactgcagccttgatctccctggctcaagcaattcttccatcttagcctcctgagtagccagggctacaggcgtgcaccaccacaccagtctcattttttaactttttgtagagatgaggtttcactgtgttgcctagtctaatcttgaacaaagctcaagcagtccttattccttggccttccaaagtgctaggattacagatgtgagctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatgtctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattttggagctttttgtttttttgttttttgtttttttaaagagacaaagtcttgtttcgttagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttgaatcaatgatatgaaaatattttctcacagtctgtagctatctttttattctcttattagcgtctatcacagaacacaagattttaactttgaggatgcacagtatatttattttttcttttatggattgtgctttagttaccatgtctaaaacctcctcatctaaccatcagtcttaaagacttctttcgcccataatttatttagaagtgtgttgtttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctacgatatctaaacaggagagcattctaataaaacccctaaactcacctggccttttagtagaatattatctttacatacagatatggaggaaaatatgttaaatgtaaattcttttttcttctctctatcttcatttatttatttatttatttgagacaggatgtccctttgtcatctaggctggaatgcagtggtgctgtcagagctcactgcagcctcaacttcctggactcaatcgatcctcccaccacagcatcctgagaagcagggaccacagacatgcaccaccatgtctggctaatttttaaaaatttttccccaggctcagtgtccagctcctgggctcaagtgatctgcccaccttggcctcccaaggggctggaattacaggcatgagccactgcacacagctgaattcttttcaaaaccagcaaatcatacatttctcatagaagttaacttccacagagatgttttattttctttttctttttttttttcatacttcgaggccaaaaaattgtcatcaagatcctagcaattgctgcagccaatcccaggactttgcttccacagtagctattgagcatcaaatgctctcttagatcatagaccacaactttgatgagctttcattcttagctatgtcttaggattctcctgaaatatgaagggtaggaagttgtattccctagttcaagggaaaaaaaaaatcaatttaaattcaatggtattaaaaacaatgaatatttacttcaaaaaattattataaagcaaaatatggtacaaactagtttttccttctaaactcaaatacctagctagtaatattccaaaaataaacattaattatatggaaagaatttttaaatttttgcaatgctgaaattaatcagtgggaatactgacgctcttacctgtgggtctttgttcttagagctcccaagatggggcgggccgctcccaagatggcagcaagccttttgttctctgaccttgggttcttggcctcacagattccaagaatggaatcttgggccatgcggtgagtgttatagctctattagaagctgtgggtcacggaagaaaaccatggaacccagcgactagtgttcagcttgattaggatgaacccaggcacttagctgtgcaggaacaatggtgagcctttagcccgatcgggagcagaaatgggcaccttgctggatcaggagcacagcagacactctgctagatccagaggggtgggagtcaatggtgggtctgagatggtggcaaacagcagtggtggacccgggtgggagtcaatggcaggtctgtaacagcggcaaacagcggtggtggacagtgagcaaaagctcagctcaagccgtaacaaacacggaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttctttacctcctgcttttagcctaatttgtgtttcagtgagccctctttactacccgattggtcaggtgtgagctgagttaccagccctgtgtttaaaggtgggtgcagtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcaattgagatttcctcaggaggagtgcctttgatgtcatcaacataggagcatgggctaggaggctgtccaggggcccacagtagatcttagtcatgcatctggggctccatttgaagaatgatttgtagttttatagctttgattctggaagacacaaacttaacaaggaggttaaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccgtgcaggaacaatggcaagcctttagcctgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgagagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggcgaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtccttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttccctttttttaattctagtgcccgagtgagggctattagttctgccagccgagagctagttcctggagtgaggggattactttcaagtattccattattactgaccactgcatacctcgcttttgaagtcctttttttacaaaggaattttcattaatatacaagttgagttagggattagtcaagggaacctctagaaggtccctcgagtggtataggtttgaacaattacctgttgacagttatgttttatctttttcattgtttggaagaaatgtggcggggttaagagttgcgcaagtatgcagttgcagcactggccctttaattaatagagcctgatatttaagcaaacgattgtctgacagccacaagtctcctttagcagtgagtatgctgtttacatcatgagatgtccacacagtaagatctcttccctgtattattttaactgctttacatactaagactgcaactgccgccactacccgtaaacaatgatgccaaccctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagcctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagtcttgagctaatgcctggccaaatagatgtgggctatctcttaacccttggggtaaaacagtccaggtgagttgagacattgggtttgaagcatctttaaaggcaaataagaattgagaatcagaatgtacagggatgcagaaaaaggcatccttaaggtccaggactgtaaaccactctgcttcctctggtatttgggaaagcagagtagaagggtaaggtacagctgggtatagaggaacagcagcctcactgataatcctgacatcttgtactaacctccactgtctattgggcttctttactcctaaaattggaggattgcaggggctattgcatggttttactaggagtagggcttttaggtccttaacaattttttggagtccttgttgggcctcgggtctaagggggtactgcctttggtagggaaaggaggtggaatcctttagtttaactagaacacgacgggcattatttgctcgtccatattgtccttctgttgcccagactttaggattaattcctttttcaagcaggggacaacaaacgggtgttccttttcctatgttcaggtgtataatggtccctgcttttgttagaatgtctttccctaacaagggagtggggtttttaggcataattagaaaagcatgtgaaaagagtaaagttccccagtcacagcttagtggctgggagaagtatctagtggctgtcccaggaccccttggatagtgacagatctggagacagttgtccaggacaggagagtaagactgagaaggccacgccagtgtccaggagacagttaacctcctggccctcaatggttaagcatacccggggctctgtgagggtgatggcatgggctggcgcttgccccaggcaccctcagtcctgctgctggatcatctggttagtggcttctgactcagaggaccttcgtcccctggggcagtgggccttccagtgattcccttgacataaggggcatggacgaggggggtggcttatttctattagaacaatcttttttaaagtgtccttgtagatcgcactggaagcaagccctattaggcattcaatttgtccagactttccctgttccagagcctccgaagtcgtgcttgcctgagggccatgactaaagtggtggccttttctttatcccgtttatcctgttctgcctgctcctcctgatctctattataaaaaaccgaggttgccaagttcaatagggtttctaagttttgctctgggcctaaggtggacttttaaagtttttttctaatgtctgcagctgactgagtgataaacttaacctttaagattagttggccttcaacagagtcaggtgacagagagtttgcttcctcaatgcctcccttagtctctacagaaaggcagtaggattttcttcctttccttgtgttatagtgaacatcactgaataatctataggcttcttcctagttttccttagtcctttagcaagcaagttagcaaatgtctgtggcaccaattccatgttctgattctgtgtcccaatgagggtctacactgggaactgcctgctggcctgtggggaattgttctttttcctctgttgtcatcctatcattgacctgactgagataccagagatcaccaaactctcaggctgcagttatggcagcacttctctcatttgggattagtgtctgatctagcagtaacattatatctctccatgtcagatcaaaggattgtcctaacccttgtaaagcatcaatatagccaacagggttatctgagaatttacctaggtctattttaatttgcttcaagtctgacagggaaaaaggtacatacactctgacaaggccgaattctccagaatacattttaggggtgtttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacctggctgcccatcaagatgcattcccataaacaacagttcttatgcaaattcgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattagggaattctcctaactcttcttccacaagagtctcactatcaattaatgaatacccattgtggtttttttctcaatcacccgagaggaagcatctatccttgtgtcccgaagggagttcctcctaggtctggtaggacctttgtatggtaattaagatttaaatcccctgttaggaaagctgctaggttaagggaattttcagtggttagtgttaaatcaccgttttctaatagaatagcccgatactttaagatttttgagttagtaagctacctttttgcttttttgacttaggatagctctgaactggttatgtgtgctcacaataaggtttcctctaaaggttatttttctactttcttctgttagcaaagcagttaccgctactgattgaatgcatttgggccatttgtgggttactgggttaagaatttttgataggaaggctacaggttgtcagtggtctcagtgtttctggctatgcccttgtttacactgacaacaaggtagtattggagtattatagggtcacagagaagaccttcgattatcaattataggttttaaatttaccctggcttttaaaggaatagggcacactgtttttctttactacttctatctttctatttctttctctctctctcatctctgtctctctctctctcctctctgtctctttctctcccttttctctctctctgcctctttctctttctctcctctctgtctctctctctctctcatctctgtctctctctctgtctcctctctgtctctgtagatggattttggaaaacagcagaaggaagttcgcttgttgaccccatttgccactataggaatatgtgcctccctttagtttactcaatttgctttcatcctgatctattatgttgttgtagacccagttccagaagttaaagtactaggtcatcagttctaaggccctggccaaggagccaaggcttgaagattgtattgaagattgcattgtggggtggtgggtcgggggatgctgggtagaaattaggggaggagagcatcttaaacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagccgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctgggtttatatcctgatcattgtccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcaattaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgatctattttctaattatataattcaaaaaattgtttcaggaatattattctaaccagttttaaaagtaacatatcaatatatgtatgacattaacattaatggcagtttgtctctttcaaacacagactatctggtacttgtatctaacaatgtatttacaattgtgatcatatatggctagtgttgatgctattaataggatgttccaaacatatatcaagtttttttttttgtggaagtcattatgataggtaatccatatttgtagaagatataagcctttacacaaagactttaacataattacaattcagattaaaattagctttattgggatgccaacaatgaatatattaaagggacatacaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccacttaaaaatgagaacatatagtatgcagttctctgatcatgcattaattcatttaagataatggcctctggctgcatccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaatttacattcccaccaatgatgtataagtgttttatttctttgcaaccttgtcaccatctgttattttttgatgttttagtaatagccattctgactggtgtgagatggtatctcattgcagttttgatttgcatttcactaacaattattgatgttgagcattttttcatatatttgttggctgtatgtatgtcttctttcaagaagtgtctattcatgttctttgcctttttttttttttttttttctttgagacagagtcttgctctgtcccccaggctggagtgcagtggtgtgatctcggctcattgcaatctccacctcccaggttcaagcgattctcttgcctcagcctcccaagtatctgggactacaggcctctgccaccaaacctggctaattttttgtatttttagtagagacggggtttcactgtgtttgccaggatggtctcaatctcctgacctcgtgatctgcccgcctctgcctctattctttgcccattttttaatggggttatttgtttctcgcttgtcgaattgcttaaattccttatagagtctggatattaaatatttgcaaggaatagtttgtgaatatcttctcccattctgtaggttgtctatttactctgctgatagtttcttttgctgtgcagaagctctttagtttaattaggtcccacttgtcagtttggggggtttttgcaattgttattgaggactcagtcacaaatcctttgtcaaagccactgtccaggatgatatttcctaggttttcttctaggaattttataattttaggtcttacattttagtcttatccatcttgagtcaataattgtatttggtgaaaggtaggggtccagttccattcttctgcatatttctggctggttatcccagcaccacctattgaataagagttcttaccccattgcttgtttttgtcaactttgttaaagattagactgttgtagatatgtggctttattctgggttctctaacctgttctattggtctatgtatatgttttggtcccagtaccatggtgttttggttattgtagccttgtagtttgaagtcaggtaatgatgccatcagccttgttctttttgcttgggattgctttggctattcaggctctttattggtcacatacgaattttagaatagatttttctatttctgtgagaaatgacataggtagtttgataggaatagctttgaatctataaattgctttgagcaatatggtggttttcatgatattgattcttccaatccatgagtatggaatgtttttctatttgtgtcatctataatttttctttgagcagtactttggagttctccttgtagagagctttcacctccttggttagatgtatttcttagtgttttactgttttttcgctgttgcaaatgggattgtattattgatttggctctcagcttaaacattcttggcatatagaaatgctcctgattttttaatgttgattttatattctgaaactttactgaaattgtgtagcagttctaggagaattttggtggagtctttagggttttctaggtatagaatcttatcattagtaaagatagataattttttttctatttagattccttttctttctttctcttgactgactgccctggctaagatttccggtactatattgagtaggagtgggagatatctttgatttgttccagttcttaaggagaatacctccagcttttattcattcagtatgatgttcgctgtgagtttgccatagatcgctcttattgttttgcggtatgttcctttgatgcctagtttgttgagggtttttatcatgaagggatattggattttactgaaagctttttctacatctattgacatgatcatatggtttttgttctcaattatctttacatcctgaatcacatttatggatttacatgtgttgaatcaattctgcatcccaggaataaaacctacttgaatgtggtgaaataactttttcatgtgcttctggatttggtttgctagtattttgttgatgatttttgcttcaatggggatattgacccgtaattttgttgttgttgttgttgttgttatttctttggcagattttggtatcgagtgatactggcttcctagaatgagtcggggaggagtcaccccctccttaattttttgggatagtttcagcagtgttggtaccagctcttctttgtaagtctgatagaatttggctatgaattcatctggcacaggactttttttggttggtaagattttatgactgattcaagttgaaactctattggaatgttcagggtcttagtttctacctggtttagtcttgggaggttgtatctttccaggaatttatctatttccttcagattgtctagttttcatggataaagtgttcataagagtctctaaggatcttttgtatttctttttttttttttttttttttttttgagatggagtttcactcgtgttgcccaggctggagtgcaatggtgcgatctcggctcaccacaacctctgcatcccaggttcaagcgattctcttgcctcagcctcccaagtagctgggattacaggcatgtgccaccgcacccagctaattttgtatttttagtagagatggagtttctccatgttggtcaggctggtctcgaactcccaacctcaggtgatccgcccacctcggcctcccaaagtgctgggattacaggcatgagccacagcacccagctgggatcttttgtatttctttcttccttttttttttttttttttttttttgagatggagtcttgctctgtcacccaggctggagtgcagtggcacgatctcggctcattgcaagctctgcctcccgggttcacgccattcacctacttcagcctccaaattagctgggactacaggtgcccgccactgcacctggctaatttttttttgtatttttagtagagacagggtttcaccatgttagccaggatcatctccatctcctgacctcgtgatccatccacctcagctcccaaagtgctgggattacaggctggagccaccgctcccggctggatcttttgtatttctgcaggattagttgtaatgtcatctttgttgtttctgactgtgcatatttgaatcctctgtttttttctttttaatctagatagtagtctgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaatttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggctaagtgttgaattgaagtctaaaatgtctttgttagttttctgacttgatgatctgtctaatgctctctttggggtgttgaaatccctactagtattgttaaccatctaagtcttttcataggtctagaagtacttgttttatgaatctgggtgctccagtgtttgctatgtatatatttaggatagtttagtattcttgttgcattgaacattttatcattatgtattgcccttctttgacctgttttattgctattggcttaggcagtctggccactccttggcaccattacagtagcttctactggggctatggcagctgatgcctagctgctcagggatccaaggcctgtgcggctccactgggcttaagtggtacccctgcaaagattccaggctggtctctgtgttgatttggagttccactgaggtcaagggcttctcccatgcccaggattgcaaaggtccatggcagatgtttggatcccctgggaactctcactcatcaaccctttcctgacttagggaactttccccaggtctgtactggtcccaggtgggcaagtccttggctttgctcctctcttctctgtgagtcctcttgctttcttgttgaatcccaacatgacatcttagatgatctacttgaagtcgtagcatttactcaccactttgttttctctccatgagagcagcatatactagctacttctagtcagccatcttgagcacctcacctgttttccagattggaaaactgcccatatctggggagctctgcatttttctttagagtgcttcacagatactgcattttttacaaattaaaagttagtggcaactccaattccagcaagtctataggcatcatttttccaagaacatgtgctcactttgtgtttctgtggcacatattggcaattctcacaatatttcaaactttttcattattatatctgtaatagtaatctgtgatcagttctctttgatgttattattgtcattatcttggggcaacatgagctatgtccgtataagatggtgaactttatcaataaatgttgtgtgtgttctgactgtgctagagaccagttgtggggatatgtgagggcagccatgttgccaggcacatgtggggacaagaggaagacaagggaaatcaccatgtttggtggacccagtttctaatggcctttatttgcatattaaagcttgcctgcaggctctaagagccggggctttcctgttagacaagaaacatttctggagctgctttaaaagaaacaaaaacttcccaaggacgccttttcatctctatctgcctaaaataatttcttaataactcctataacaaaaatatactgcaaaagggtcatacctgagaagtctgcttgttgagttgtggtaatttttgcataaatattctagaaatatattgtatgaggtgggaagtggtggtagtgagcagatcgtgagacatcagcttaagtattcattaactacttcaggaaactggagattggaggtctccagtgggaaggagattttcatgaactcagaaaaaatacttcataagggaaagagctaaccaaaaagcaccaaagctggactaagattttcttgcctttctttttccactccattggaggaataagaagcagcagcagtgaggaacaagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaaagggggaaatcgggaaacacacaggcatactgggagaaggccaaacacacaagagatggccatctgtaagccaagcagagaggcctagaacatattcttccatcacagtgcttgaaagtaatcaaccttgtcaacacttgattttggactcagagcctgcaaaattgtaagacaataaatttatgtttaagctacccagaagctttagttctagaagccctagtaaactaggggggcttgttacatgaagcaagtattcccagctcaaggaggatttactgaatgtggagacttggctgatagggggaactgatgaactcttttaacatgcccaatctgtgccagaatttgaagtgtgaccctaagacaaggctcaaaaatctctgccttctttttggaataaagtttttaggatcactgccacatttattttttaattatctatggcttttttaatcctatcataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagatcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaagaaaaatgtaataatatcacaatctctacaataaatgttttagcatagcactaaacccacaatatgctaaaaaagttgtcagtagaggagacagaaaataatcctaaagaacaggattgactggtgtacattaatcctgacttgcctttgggaaaaaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatctataaaagggatcaggttgaaatagatggtatgtctttaaaaagtctttaaaggtttaattaagtagtctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtacttgctaatttagatttcctcatggagcacagtaaatatgagagatcctcataatagcctctataggtttaaattatattttaaatgtaaatgcaaaacttaattattttttagaggacctgatgtcatccttgggagtaatttttaattactttttatccttcttagagttgattgtattaattatttgtactggcttaacaataccatactgaaaaagcttttatttttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcctccctatcattccaaaatccacaatggtcaagtcccttatatacaaatggcatcatatttccaaagaacctaggcctatgccatatactttaaataatctctagattacttataatacctaacacagtataaatgtcatgtaaatagctgttatactgtattgtttagggaatagtgacgagaaaaaaagtctgtacatgtttagtatatatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatttcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccgggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttacactgtgcaaatgattacaactatggctattagataacactgtgaagttcttaattttagtgattaagaacgtaatttcacaacttgatgtaagaatgatagtttatataatttattaatcatgttataactttatctgcataacttttatgcataatttgcaaaatacataccaccacatttgctctagcaagttttagtatttaatgaatgggggtcatagttaataaaaatggttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttcagtgggaaaatatgaaagtttctattgggttttttcatcatgatgctaatgggcagtatccttcctagctggaagctcccaagagggagatgaatggcagctgaatttgtacctccaggtgctaaggtccatctacctctgaggatgggtcagtagcagctgtatttttaggaggctttgcttaagtttagataaatttctttctgtggctgctctttgttcagatgtgttcaaagtagtcagaccaggcatagtggctcatggctgtattcccagcactttgggaggccaatgtgggtcactttagcccaggaattaaaaccagcctgagcaacaaagagatggatgcagtggctaccatctgtaatcccagcactttgggaggctgaggcaagcggaccacaaaagcccagtagttccagaccaacctgggcaacattgtgagatctcaactctacaaaaaaatacaaaaattagctgggcatggtggtgcatgcctgtagtccaagccacttgagaggctgaggtgagaggatcatttgcacccagaaggtcaaggctgcagtaagctgtgattgtgccactgtactccagcctgggctacagcaagaccatgtctttaaatacatacatacatacatacatacatacatacatacatacatacatacatgtagtcttcatgccacttcagtggtctgttggtctcttcagttttcattctcactgttgccttgtttttttgtactaaaatcaaaccctgcatgtgttcagttgcctctacatccagggcctcccattattgtggtaaattttatctgatcacttcttcctctttgcctccctctatgccacttctgctctacttcttggttgatactcaagccaggtcagtgactccctttcttcttgaccaatggaagattatgggaatcactgagtcaaagaggattacacacttattaaatactacaatgcacattgaaagtagttgcttagttgaaaaagataatgttaaaaatgtataatcttgaccaggcgtggtggttcaaggctgtaaccccaggactttgggaggccaaggcaggcagatcacttgagttcaggagtttgagaccagcttgggcaacatggtaaaaccctgtctctacaaaatatacaaaagaaatttagctggatgtagtggcacatgcctgtagtcccagctattcgtgaggttgaggtgggaggatcgcttgagcctggaatgtgggggtttgcagtgagctgagattgtgacactgcactccagcctgggcagcagagtcagacccagtctcaaaaaaaattataatcttaacagtaacataaaaattagagtgcttcaacaaagcaagattttacacaggcatatagatgtcaaatctctgtctatccaagtattgtaaagtaggaaatgccatttggctcacggattccatcttctccagttttatggcctattgcagacatattgcctaccacacctaagtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtaacctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcattttcattttcaactctatgggatttctaaagtagattaataacacattgaagaatatatttgttttgcaaaatggcaatatttaggcaattccagtattctgaaatataaaactttttgggtgattatatttatttgatacttaataattataagtaaaaaggttttgtaacaagaagaagcaacaatatgcctgaagcctatgggtctgttggaatgagtaggcaataggcatgaagtatttgggaataatagtttatattaaatatttactaatgacctggattatttaatgaagaataacattggttaataatcataatgccacaattcagctagaacagaaggatatatcagtcctaaagagcatattgtaagctgggagatgggtattatgttcctaaaatagaatcacaatattttaggtcatttacattgtcaaatctgctacataaagggtgttctctctttttcataagagcaaaaacctactacagttttgtctctacagggattcttctaagaactgtgacagtttaggtaagattatttaaagacaaaaatgtccctttgaattaaatatcaggaataaaccacagagtttactttacatggcagtgtgtgtgtgctgacaggacactgataaaacatgccagagagatgtagatgcctccttcagacccctctagtctcatttaatttaaggatttcttccattaaaagcaatagtgtttgaataagagagcactaagaaaatacatagaatggcatgttacaaagatttttcacaacatctttgtttttgtttttctaattaacattctttttttggagtcagggtgtcactctgttgcccaggctggagtgcagtggcgtgatcatagctcactgcagccttaaacacttgggcccaggctatcctcccacctcagtctcctgagtagctacgactataggtacatgccaccaagcctggttaattttttctttaattttgtagagacgacgtctccctatgttgcccaggctggtctcaaacacctggtctcaagggatcaacccaccttggactcccaaaatgctgggattacaggcgtgagccaccgtccctggcctctcaacatctttattggctaatcatcaattggatcatggaaaaaaaattataatgtaatgaaggcagcccatgaaattgtaattatttacttatggaaggaagctttctaaaaacagggccatttttcactttgtgggatggttacagcatggtcctactttaaagaggatccaggtttctattaacttcctaattttacatcctgcaattctaattttgtgagtaaatactcctagtagatgtctcagaaaacacccacttatagcaatgatttattctgtggcagtgagttaactctctcccatgctctcttttcctttccagcatttgtaaaagaagattacatctatgctgcgactattttaagtagctttgtttgaacaatatattttttcttaactttaatactgatgtttataacggcactttaatctacatcaactctttctaatgacaggccactttactttgggtttatttgggtaacactttctaaatacatttcactaccccaggctagtgggctaacaaaatgaagaagcagactctgtgtggtattttaaagggagggagatgccaaaagcattgcaggaagaaacacatccttaaagattattaccacggtgtctaccagagtaaggagtaggtggcataacattctgagatataaattctctgaggcagaacatagaattttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggtagtatgaaatcacccatgatgggagtatttataccttggaaatctgcaaaggaggaaaaacagtgctctagtcctctggtcttaccaccccttttagggagtaccagcccaccagcaccagtttactgacacagattcaacccaggttggtactatacaaaaagcacattttcattcctttctttcaagatgacaaacttttggattcctaaagaattaagaactgttacccagaaaaaatgggttttattcttttggtgagtaacaaaggtctttctggagacatggatgatgctggaaacatcattctcagctaactaacacaggaacagaaaaccaagcaccgcatgttctcacccataagtgggagttgaacaatgagaacacatggaatcagggaggggaacatcacacactggggcctgtggggggtgaggggctaagggagggagagcattaggagaaatacctaatgtaggtgacgggttgatgggtgcagcaaaccaccatggcacatgtatacttatgcaacaaacctgcacgttctgcacatgtatcccagaacttaaagtataataaaaaaaaaagtcagaggaatatatagcaggctcaaatatttatctttttaattgtgaaatcatctttgcaatatttattatgaaataagttttaaaatattgcataattctaaaatatgatttaaaataaattatttctctgtagtaaaaaaaaatagagcaggttttgatcaatagaagtttgattacttggcataagtaaggaggacactgggagttttcacaaaagcagtgtctcccagaggaaaagtgacagggaagttttatggggtgatagggaagaaggtgcatcatctcatgtagaggaagagttccagttgcggagatgcagtgagtaatcacaccagtgcgtagatcgcatcttatggtaatgaagctatagctcctccccagggtggagactttagcatggtaatgaggaaatttcacacagactcgtctatgagttgctggggtctgtcagaagcttgccctaaccaacaaggtgacagcattacacaccaggcttgggaaaaaaacaagtgatagggcaggaggctgtaaaacaggctgatggttcaactttattaaatgttataatccctggagacccccctgcctgcttacagaactatcacattcagggcatcataagatacaacaatgtaacagcactcagaggcgcttcatcttaatcctctgttttaatttcttctatgtttttcaagtgtatttgccttcttcatttcatggaaatttcttgaaagttgaagtactctatgtattttgcatttttctactatgcctcctgggatacttactagaataataaaattgagctggaatgtgacagatgaaattgctagcaaatatgtcaaaccaagtagtattggctttgattattcataaattttgttatttacctataaaatggtatcatgagtataatcacattttatacacttctattaaatttacagattatagctatatttcaatttataatcattttagtctctagccttacaaaatagtatggaagttttagtatagatactacattctacaggtataaaagtagtgttcaaataatcttaaaaattgcaaaataactgagaccaaaaaaattagactctagaatatagcaaaatattaaaataacatatgaacaatctcccccattcctcacaaaaagaaaataaaagaaatttaaaaagagaagttaaaagacattaatcccaagtattatatattttgttttaaaaaggcctgattttatataattactaacacatagaaaggtccacatagaaatgtttatttgctaaagctgatatttgaaataatcacacacatgcacataaaagctaagatatgtttatgtccgttttcaatttcagagcagcctatggtcatgaagtggggaagcgtccttggattacaggagatgagagtattgtaggccttatgaaggacattgtaggtaagtacaaaacactgaagtttttccaaatgaattgtaaagatgttatcatttagttataaacacaggctcataaagtcaaaatcttattgaagaacatagtgattttctattttaatctataatagtaaaaaggaagtacactttcaacttaaatttgttaactcaaagattgctatggtgagcataacaaggttatttatataaaaataaaatatatgttatttttttctgtcatactttaaatgtaatatttatcacacatgaaaaacacatacattgtattaatttataattgaatacatttcataaaaatcaactgaaatgaattttctataatttaactatttgatataatgaacattttcacatgctaaaggtgtaaaacaccaatcatgtttttgctcatttcaatttaatctttggtgatctatttaaattttagcttcatgttactgaaaatgacatagctgatgctgtttttagtctaaaatgtgctatcctaaagagagttatatatactatcggtggtatttaagatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttatttaaaaagtaattattgattttttgctatatgtcatgacttgtgggagctctgaggacataaaagtgaataagggctgggcatagtgacacacacctataatcccagcactttgacagtctgaggtgggtggattgcttgagctcaggagttcgagaccagcctggccaacatggtgagatcccatctctacaaaaaaattttaaaaattagccaagcatgctggcacacccgtagtcccagatacttgagaggctgaggtgggaggttagcttgagcctgggaggttgaggctgcagtgagcccaaatcgtgccactgttgttcagcctggacgacagggtgacaccctgtctcaaaaaaaaaaaaaaaaaacaaaaaacgaacaacactcaccttccttatcctcatagactgccagtaaaggaagatgcaaataaatccaaaattaatgtacatacataagtaaaatacaaagaaatataaaattaatcacactaccaaagaggcataattttccagttgatttaggactgaacacatgcatgtaactactcttttttctaaaacctcaccaaagaattctgaatggaatagaaaaaaaaattacaaagtctaaactgcagaggacaaaatagaatgccaaaggagatgataataatatctggggagttggctcgctgatagacaagtggtaattgcctttctcaaaaaaaaaaaaaaaaaaaaaaaagtaaaccaaatcctaatctcccaatggcaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaagacatcaatctacacatgtgaagtatccataggtttgggggagaggaggggacaggcgcacaggtgggaagtgtagtagtttataggtcataggattatagatggagtcaaagattttctgattggcaatttattgaaagagttaagttattatctaaaaacctggaatcaatagaaaggagtgtctggaggaagataaggggtgatgaaaaccaaggttcttattatgtagataaagtctcataggtggctgcccttacagacaatagatggcaattgtttcccattcatacctgtaaagggttctagtctctcagttcatctcttcaggattggaagggactgaaaagggaaagatttggttatattcttcatattcttgacagatgtaaattttccctcacaacagaaggctttgtagggccactcaaagtatgtcaaagagacatattttggggtaaaatattttgattttcttctttatctgtcatttgatgttacgccagagtaaggttggaaagtaagcttgtcatataggataaaataaaacccatctggtgagattttatggtttgtaggatgttattccccaggcctcttaggaatttgggcaagacagaaaaaaggtcagagtttagtcctcacacctccagaaggtagtgatgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacgcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaaaaacaaaaaataagagaaagactataaatattcagtcttgtttagaaaactaaagggattaagcttattttaaatttttaaaagaaaatttgtcaaccatagctgtaggggttttctgcctgtctttgaaaaaccacacagtaatataatttatattctggcccacaagactgccgccacttcagatgccagtcaaaaatcctagaaaccacccttactttagacgcaccagctgtaaattcagggatttccacagtgccctttgcaggctccataatttgctagagcaatttcagaactttactttcactttactttatgtttgccagtttactataaagatacaactcagaaacagccaatggaagagatgcatagggcatggaaatgagggagcttccatgccttctctgagcctgccactctcttggtacttaaatgtgttcatcagcccagaacctctctgagtcttactgtttttataaagctcaatcccagccctcctctccctctgggaggtcagtgggtagagctaaaagtttcacctctactccctctgatcacttggtctttttgatgggcagccccccatagtgagatgtctctcagggccccaacttaagtcactttattagcatcaactctcctgtgatctaagggagcttgttatgaataacaaaaaatacttttaccacttggaatatccaagggttttagcagccctgtaccctgaactgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagcccaggagttcaagaccagtctgggcaacatggtgaaactccgcctctgcaagaaatacagatatacaaaaattacccaggcatggtggtacattcctgtagtcccagctattcgaaaggctgaggtgagagagttgctggaacctgggagtttgaggctacagtgagccatgatcatgctgctgcactacatcctgggtgacagaaaaaaaaaaaaaagaaaaaaaaaaaagaaaaatgtgtaacttcactcaaatagactcttttagaatgtgtttttttgtgtgtgttcattttgtttgcaaaccccatgcagcttcccgttttgccttggttactaagaagttctgagaaaaatttgatcaagtttgaagtaacaaaaatatttaataaattctaatttgtttctcatctgcatttattgtgttgctactttctatcattcttcctcaaatagttttgtattacaatttatctgaaaccctctttggaagtaagtgtggtttaaatgatgaaataattaaaataattttgtagtaactgcagtaaagagtagcaaaggccaaatttattttttctacttgctagggttactagcagcaaatccatatgggtctgcagcaacctcggtttttgcctctttagaagaaataattcaactgaggggcgtaaggcaggagagatcaaggcaaattttagagcaggagtgaaagtttattaaaaagttttagagcaggaatgaaaagaagtaaagtatacttgaaagggccaagtgggcaacttgagagatcaagtgcatggtttgacctttgactttgggttttgtattttggcatgcttctggaggcttgtgtcccttctcccctgattcttcccttgggatgggctgtcctcatgcacattggcctggtagcacttgggaggggctgcatgtgcagtgtgtttactggagatatgtgcatactcacttgaggcattcttcccttaccagctgaatgtccctagaaggtcacataagagacattaaaaattggccattttgcctcttaatgtacatgcttgagcccactcacccaaatcctgagatattgggaaactgctgatcacgagtttcaggtttttttctatcttttgggagactgtctttccctggcactggctgcaaccaattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgtcatccccactttgcaagagatttgaaattatgttaggattaaaaagacacagagggaagttggttaagatcctcagtctcaagtcaaatacacagagtattttctgtaaacaatgctttaaccctgaaagaacattcttattttatttttcttctacaagacttttggtcagttagttcatctctttgcacatcagtttcctcgttatgaaatgaagagaattagagtaggtaccttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcagagatccatcagagggatcactatctgtggcaacaatatcctcacaaaatgctttttttaattgtatttaatttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttgttttttatttttattttttatttttgagacagagtcttgctctgtcacacaggctggaatacagtggtgcaatcagctcactacagccttgatttcctgggctctggcaattctctggcctcagcttcccccgagtacctgggaccacaggtacaagcgaccatgcctggctactttttgtatcattggtaaaaatggggtttcaccattttgctcaggctggtctcaaactcctgagctcatccaatccacatgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttctttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctatgttaatcctgaataagattctgcctgtcccttgaaggtttgtagctgagacctcctttctagccataaagtcctagatagcatcttcttccaatagaggactcattcatctacactgaaaatccgttgtttagtgaagcctgcatcaatgatcttagcttgattttctgggtaacttgctgcagattctccatcagcacttaactgtttcaccttgtactttttgtatttcaaatagccaacttgagacaagtttattagtaatttcatggtacccttttgtgggctgattctcacctcacccttccccaagcaactcctgtgactaatgtcaaacaatatgtccttttgttgcttttttcagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgcttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcatttctgctgataatgctgtgtgctataattatatgtaagtttataagaaacctggggtaaaaccgtggactttctcccttttgctggcatcatctacagaaataccatgggcatcatgaaaggcagtatagctataggctgaaaaaagcagggttcagtttgctgctgtcatgatgccctgttgagagactgctcttcaaagtttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaacctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtccctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaatgggagaaattggccaaaacaaaggggctacaggccccatgcaagtccaaaatccagtggggcagtcaaatcttaaagctctgaaatgatctttgattccatgtctcgcatctgggtcatgctatgcaagaggtgggttcccatgtggtcttgggcagctccacccctgtggctttgcagggtacagcctcactcccagctgccttcatgggctggtgttgagtatctgtggcttttctgggcgcatggtgcaagctgtcagtggatctaccactctggggactggaggacagtggccctcttctcacagctccactaggtggtgtcccagtaggtacactgtgtgggggctgccaccccacatttcccttctgcactgccctagcagaggttctccatgaggatcccacctctacagcaaacttctgcctggacatccaggcatttccatacatcttctgaaatctaggcagaggtgcccaaaccttgacttctgtgcactcacaagctcaacaccatgtggaagctgccaaggcttgaggcttgcaccctttgaagccacagactgagctgtaccttggcccctttcatccatggctggagtggctgggactcagggcaccaagtccctagtctgcacactgcaggtgggctctgggtcccacccatgaaaccactttttcctcctagccctctgggcttgtgatgggaggagctgccatgaagacctctgacatgccctggagacattttccccattgtcttggggattaacattctgctcctcgttacttatgcaaatttctgcagctaccttgaatttcttctcagaaatttggattttcttttcatcgtgttgtcaggctgcaaattttccacactcttatgctctgtttctcttttcaaatggaatgcctttaacagtacccaagtcacatcttgaatgctttgctgcttagaagtttcttctgccagataccctaaataatccctctcaagttcaaagttccataaatttctagggcaggggcagaatgtcgccagtctctttgctaaaacataacaagagtcacctttgctccagttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaacattttctttatatttacaacttggctgtttggcacaagagacctagctttcagcctacctcagcttttgacatgtctgcctcactaagcttaatcatgtccagcttttgatttaaagtgacaggcatatgacacttcctttcacttgaacacctaaaggccattgtagggttattgattggcttattttcaatgttgagtctcagggaacagggaggctggagaagtgggagagaaatgggggaagggctgatcagtggagcagtcagaacacacaacatttattgattaagttctctgtcttatatgaatgtggtttgtagcatgccaaaataattacagtattaacatcaaagatcattgatcacggaaataataataaagtttgaaatattgcaagaattatcaaaatgtgatacagagacatgaggtgagcacattcttttggaaaaatggcactgataagatcagttgatggagggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgtatatgtgtacagaaaaattgttcaaatcaggaagggattatttacaaagaattggcccaagtgtgaggaggccattgaaagtgaaatgagggaagctctataccaagtgtaagtgtagtttaattctgcccagcacatctggaggggaacatgtgtgtaggtgcatcacattcccaagccagaaaaattttaggtgattcaaaatgaacactgtattgtttggagaaccaaaatgtccaggaatctgtatcgtgttttgtttgtttgttttgttttttgagacagaatctccctctgtcaccctggctggagtgcactgctacctctcctgacccgccaccttccccaggctcaagcgattctccaactcagccttccaagtagctgggaacacaggcatgcaccaccacatccagctgttttttgtatttttagtagagacagggtctcaccatgttgcccaggctggtcttgaactcctgagctcaaaccatccacctatcttggcctctcaaagtgttgggattagagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatagagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtcaaatggagaaatctatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttagcacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagtacaaacatctaaattacgatatgtttattttacaggagccaatgagaaagaaatagccctaatgaatgctttgactgtaaatttacatcttctaatggtaagttttctttcccactaatgtttagaacacattcatttacagaatctgatgtttttctatctttaattcatgagcttctgggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtatattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttttggcatctctaagtcttagtattttcctttgtaaaaatgagaaacataatatctacctcaaagatctgcatgagaattaaatgtaataatatgtgaaaattgctttagtaccctggccagtgatcaacactcagttaacagtagctatcatcttcgttgttattgttgtcaatatcactctctaggaactgtgtggagaaatgaaagagcttcactgaacaaatgagctactatcaatacaaataagacatacatagaccataatatttcagtgtcatgccatcaaaattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgatagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttcttttgttaaagtaaaacacgtgttaagggaagagaagatggaataggaacattgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttcttattctaaaatctcttataattccttaagtcaaggagatccctctgttttcatctatctcaaagaatgttcagaattctatatgtgaattttattaagtggttcttctctgttgtgtattttgtttaggtgttttaaccttcaccttggatttaatataataatatgcccttatttttactttattatttgttatttcaatgtacttctgtgctctcagcttgatttgataaatacatcatctttcctttttagtatgctattgagtcacaactacaacttcacggacttaacattgaagaaagtatgcggatgataaagccaagagaggtatatgagaaagaaagaaatatttgtcatgctttgtttagtattgatttttttcttcattttcctcaaaagtttattaaaatcttcattactttaatggaactttcaagaaagcatgaaggacctatacttctgttactattagatcattttgcttaaaatagagaataactcagatgtgtatttattttcatttttcaagggctagccatatggcaagcaaactatttttctgttaataccactggattctgccatattcttcaatgggatgggaaaagggtgacaaatttagtatatcattttcaattccaaatgtcatgcccatgggtgccattaaaatcatgctaaagaccagaattatttgttaaaatggaatcgtgactatatttcatgtcccctcttactctaagtatcaaacattttctttgtgtttagactaggatagtggagaaagggatgtggtataatgggaagagctttggctttacagtctggctaatatttccagtgaaatctcagactctccagtttactgggtatgtgactttgggaaagttactttattctctgagactcctttatatttaaacagataacaaaagcatgtgtctaatcaggcttgacctaagatctaaatgtgtactttacattaatagagataaaaggctcacagactttgacatttaaaccctgcagcttgtgtaatttgtcactagtcgaatcatacagaataaattttaggtttcacataagatgctcccagaccgctagtcattgtttggacaattacttctttcaacccagaattactttgaataaattaaagatgtactctattcacttccatttgccaacatacaataaattaatggaataaaaagttctcacatgagaggatataaattgagaggatataaattgttaatttctagcaaaaatgaacatagctgctaataatcacataagtgaccaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtatacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacagcactggagaaaattcatggctgggtgcagtggctcacgcctgtaatcccagcactttgagagtttgagacaggcagatcacgtgaggccgggagttcaagaccagcctgaccaacatggagaaaccccatctctattaaaaatacaaaattagccagatgtggtggcacatgcctgtaatcccagctactcaggaggctgaggcaggagaatcacttgaacctgggaggtggaggttgtggtgagccaagatcgcaccattgcactccagcctgggcaacaagagtgaagctccgtctcaaaaaaaaaaaaaaattatgaaaacttcagaattgctaggatacaggatacacataggtactttgtatttaactaatttttttcagctcaagttgtttgcaagaccaaatctaaattcattcacaacctttagtaagtaatcaattattagttgtagtggcaagatataaggaaaaaaccctctattatagtcagttttattgatatttttcttcttgtttgggtcttgagctttagattagtttggaggagattttaatcttaatctaatagaagatattggctaggtaaaactcagataaaagatgtgtaagtgttatgttttctttggtttagtttaatttagtttagtttttttctgagacagagttgctctgtcacccaggctggagtgcagtggcactattctcgtgcttccgccacccaagtagctgggattacgggcatgcaccaccacacctagctaatttttgtatttttaataaagactgagtttcaccatgttggccaagctggtctcaaactccttacctcaagtgatctgcccaccttggcatcccaaagtgccaggattacaggcgtgagccacacacccggcatgttttctttttttggaaacaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaataataaaaattatgctcaaatgctgctcttatgccagatttttaaagaaccttaatctgaaaaaaaaaactattttataatgcaaaagggctcacggtgaaatttagatcggcaatatgaaattacaaatttattattatcgatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggtctcacctccttagtagcagctgctctgtgcatttgcctctagtcagcaggccaggcaagctgtaggtgatgccattggtactcagctggtcagtcaccaggaagcagacaaaatacttaagataggaagtacatgctaggtctattaaaaattcaactcatactttgtcatactataaatcactctataaatgagttttcacttaatgctgagtatctaaagatgaagaaatgcagaattcaattttatcagtagatcaaattttatacaagttactttaaggaggccattttattcctaagactcttgaaaattttttatactgcctgtaatgagagctttttttcctacccactactaaatcacagttaaattgttttgaagtcatgtctctttgtatgtaagtgtttgtaaaaagtgtttttagtatttatttgaaaaaaaagggcaacattcaacagtcacaatttgtgtttaaaatctttaaatagcacttctatttcattcagcaatcaagccatgtatttaaaaatgtgacaattgaattttattctgaacattaataagttatgggattaatatacatgtgagatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagacatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcccattgaaacacaaaataaatttgtttactttaggttttataagtaaatctcatacttaagtactttgattgctaaagccatttgttaaatgttttgcaggttttctttaacttaaaaaatatagtaaatgcctaccaagttagtctcatagaactctcagtcaaataaatgaaggtaggaatgagcagctttaagtgtaactatgaagaagcaatcaatactatgggaatcaaatggggatatagcagatgtagatttatccattatcaagattattctaacaaatttttaccctcttgctgtagttcctcctattatcaaccaaggtgaggcaaagttctttgaaatgtagacttcgataggtctctctggtggtctggtcatctgtgaataaaactgaagagagaggcagagaagaaattaaaggtgtcaatcaagaaagagataggaaattctaagaacaaagggcatgacacagtcactggtagatttggacatgtgaggcaaaaaaacgttttcagaaataaagcatggtgggaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctataacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccgtagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgagaactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttccctgattattgataagattgagaatcttccaaatacttgttgattttctatatatcttttatgaaatgcttgttcaagtgtcttgcccatatttctatatggttagctttcttttcctggtttgattgtaggtggtatagaaattgattttgaaggagagagaaaatacaagatttcaagtggtcatcaaagaagaaaactaattaataaaaagaacaattgataatatgactttgattcacacaatagatttaagatactgaggcttttcttaactgaggaggcctgagattgtagcaagtgggggaggccaaggaaaacaggttagagagctcaataacaagggaaggccagcatgtggcaagagacatcagtttgaagatgcttcttcaagatgaagatgtgccaacccatctttttggagctctgtcttacttccatgtttctatatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcctctttcattgctcctttttcctttttttctatccctttattcttccccctcgctctcctttctttttgttctctcccttgctctctctctttcttttttcttttatcgtctcatttcacaaagcatttgaaacaattcatggaaaattgacaaggtgaaaataagatataaagcaagaggaatcaagactgtatgcctaaatcatcttgaggtatgaatagactttcccacaaatttagattataataagaaataggaaataaataatgaaaaatattttaataagaactcttgatgtgttaggtagaatagttattggttataaataaatacagtcacaaatgtcttcacagtgatagatgtttatattttactcatgcatcgggcaggaattaactttctctccatccattaattcaggtttccaaaagattcatggttgtgtcctttggcttttgtgtccacagcctctgtctggattcagtcaaaggaatgcacactaacttctttaaagtcttagcttagaaatggcaacatttacttccacttatattccattgactaacactcagtccatgaccttttctgggaaatgaagtatcactgcatgctcaagaacagctgttagttttgctacacctggaactagttattgtgtgttcctgatggaataggatacttattctaagatgcagtatggcattttcattaacagaatgtgtagatcaggaagacacagtcagacctggacttgactctaggtctctacattacttttcagcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaagaataatctaagcagtttggccaggactcaagagactaaactgaagttttaaaaagttaagagatggaacttacaaaaattttaatagtcttatttttaaaaaactcagcacaaactctttgtactcctccatccctttctaatttcatctaaagtggcttaaagcacatggaaacttaaatgggacctagttgttaggaagagccaaataagtatttgttgaatgaatgaatgaatgaatgaatgattcccttaatttctcacatcttttacacattttagtgtacctaatggatgctggcatatttgttttttttcagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaatgatagcccaggcagtttgaataaaaatgaattacttctggatccagaataatttaaggcaaaaatcagaaatacgaataaagacatcattaataaaatcatttagtaaaatcacaggtacccaaaccacatttaaatatgaatatccacctcagtgaaccttctatttatcttcagatagtcctaattattttttaaaaacaattttgagtttattttagaacacaccattgagtgatcaagcctcaaatttctacagaaagcttggccgtgatgcttttagtcctgaaaattggaaatcaactgtcgtaatattataatagaataatatctctgtaatatctctattacagtagaatgatatcaataatacatgggatatcagaacttgagcaattaattagctagaataaatgagtactaaacacttttgtgtacaaatataaattagcataatgtatgaaatttttatccataaaaattaacctctttcataaaagtttaatactggaatgttaaataagtcatctttaccagaaattgttgacattagagacattttgctattgtcactggccattcaccgaataggatcttagtgtataagaagaatcctgtcgctattgtttctatagtagaaccatagaatagcatgcatttggatcttttatcagtacatatttggtcagtaaattataataaaggagttgcaaatagaaacacctaacttaacctggattgtcagggtgagaccttcttaaagaagatgagatctgagccaattatagaatatgggtagaagttatcaggtaaaatcccttctagaaagttaaaaatattggtaggattgcagggaagcaagtatttcagtgtaatttgtgtaattttagaaaagggaggacaagtctataaagcagaccaaaggccaactaaagaaggtcccactaagccatttagctttgccctgaagacccatggaaagccattgaaaggttttagccattcaaagagccatatttatattaattttacaaagaaatatcctgcatatggtgatgagaatagattggaatgaaatacaggtggacgaaaagaggcaattgcagtatctttgcaagaatttgaaaactctctgttgcgtgggcgccgtagctcacgcctgtagtcccagcactttggaagcctgaagcaagtggattgcgtgagcctaggagttcgagaccagcctgagcaacatgttgaaacatcgcctatataaaaaattaaaatatagctgggtgtgattgtgtgtgcctgtagtcccagctactcaggaggctgaggtgggagtatcacttgagctcaggaggtggaggctgcaatgaaccaagatcacaccattgcactccagcctgctggacagagtgagactctgtctctaaataaataaataaataaataaatatgctctgtcattatgatacagttcaaaagatgaaggtatgaaaggacagatccatttcatgcacacaattttttttatctcaggggaaatcatttttattcatcctcattccctcagtgacaataaaaacaggttacgtataagcatcagaaataaagtatctgtactgaactcctgtagtttaactcacctttggttctattcacagaattcaagaaaaagacatgttaaatacacacaaacacacacatatatatatttgtaaatatttttgggtatgcttatatacgtgtatatgtacgtgtatatatatacttgacacattttcagggtgatagaagatatactatatctgcttatgaaaaatgttgattaaggaatttacacctgtattttgatgtaggggaaaatgacataaagcttagatgcaatgttccattagctaattggtctttactcttcactttggaaatagtggaagattgttttgttcagacagatagtgaacaatctgtagtcttaaatccatgcaggtggaagcctaaaatatgtcaaataagtcaaaatatgttggtgaggatcagtgcccaagaatctgaaaattttgagctgtttctaagaagtcttcatcaggtgtttaatttaagcttttgattaaatagaccatttgagaaataatgattaattctcaatggaaatgaagcctggcctccagatgttgttataggattacagatctgggaaaagcaagcctcctggttgtcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttctaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacctggcatcaaaggaagcaatttagaagcagtgtcttcgagaattgtcccatagtgtctatgcaatattatcaaattcagtatgtaaataaatattttaaaataaagtaaatttggttgaggaataggccattcatgttgacacagtaatcagcagaaaaataccttatgggagactgttcctttattttatatctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcctactttgtgcctccttgtcttcctttttagctttccctccacctacatattcccacaagtgaagattctcctttcctctattcccagtcaaccattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagtagagtgttcaatgactgattgagggtagaccttgcaaatttcacagattcatgtgctttgcacatagtctttcatcattaaatacatacctgctagacaagtgaatgtataaatgtgtgtacatcagcagtcaagtggaccaggttgatttgatggaacagtactgcataaaaagcacaactgtattcctgcttaaaaagaatcagaagcttctacagaataacttataatggttaattagtctaaaaaatcaagatgctttttgtaagttttgagttctttttcaaattccacttctattctttgacacacttaggacgtgcagactgctccgttaagtcattaaatattaaatgaactaaattaagcttgaaaaactaccttaagctatttttcccatcttgagtctcagaaataaatcaaacaaactacattttgtgtgaggtccttgctagccagagaaagactgtagaagagaacagcatgactgaatttatttaatttttcttggttttcatacttacttttgacagtaagtaaagacaattatttttttctggtaaaaagaaacagctgaaatttgctctttcaagcatatactttatttaaagtggcgtgattattgtacctgcaaattatacaatggtttaggggctcaggattggtttgcttttcctttcttccaaaccctttactcttatccatccagctgtcagttctctctaataccttctcaattcacacctttcccttaaatttcattagcaaaatgctcattttcttccctcctcttatctctcatctctggatttgacaatcttgccaatgtctactttaagcaagcagagatgaaacagtgaatctagtctctgaaataatgcttcgtaaaaatgtgaatgataatagctacagttgatggcctactgtgtttctggtacttgacatgtatttccaattttcctagcaaccctaacagtaagttttcaccactgctcatttgaggagagtgaatctgagagagtttaagcacttcctcaaggcaatttagctggcaagtaaaggctagaatttgtgtctagctatagctgataccaaagctctctttccacagtattgtcttgtctatatatatatatgaatttgccatttatagtcaattatgtagactacagagacagaggccatatatatatatatatatatatagagagagagagagagagagagagagactgactacagagatgaggtctctctctacatatatatgtatgaatttgccatacatagccaattatgtagactatagagacagaggtctcagattaccaagaaaagaaaggaccaagaaaaagattgtatctttgatgtttgtaatgctgacaccaatttgccattacatgattagtgtatatatatacacacacacacacacaaatcatatatacatctaatatatatttatatataaactaatctcatatatacacattatatatattttgtatgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaactcacaagttttactttgctcctaaatgtcaagaaggcatagcctaaatgtcaataagcatcaaaagtctttctgaatgagatagtgccagcattcatcactgttccttctcagaacctcaagcctactctttccaattaccctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaaccttttatctgtagctatctgcttaagaaaaacaggaaaggcagcttctagtatgactcagctttcagctttttccttttggcctagtaaattgaggtcccagtttttattttcctttcacaccactgaagttgagaagctgtcatttccccctgccatctatttgcataactagagggcataacaatggtgccagattctttgccagtttcccccaaggagtaactgactagctatgtaaatcacattgctggaagccttctggaacttaaacaaagagtaacttgagttacatattaattttaaaaaatgtaaaggctctccttcttgtgaaataaacatagctcaagaaggcctatacaaattgtgatagcttggccatcttcagcatcttcaccatcgctgttcaggaatccagggtttttattgaaagacaagcatcagcttgcttctgtccagcctcttctctccaactacccattctgtgactcttttcccacaggacattcccttcatattttcctttagagtagcaatagttataagctactacacttttttaaaatattagggtatggcttgaaatcagtgggtaataaaattctaatgataaagtcaggagccacggaaatactggtagaagaggcacttccccagcagaggcctcaccctcaagcctggagaccatggccctaaatgagaacagttatccctgttttcctgcctaaatgttgttttttccaaaaccaccctggctcaccatgactgctccccccaccaaatcctgtacccataaaaaccccaaactcctctggcagaggagcagagtggcatggcagaaaaggagagaagaagcatctgaacatcaaagaggcagctggacagtcagagaggatttcagctgggacagccaagctccaggggaaaattagctacctactccatcccctttccagttcctcatcccactgagatcccacctccatcactcaattcaccatcctttaagtccctgtgacctcattcttcctgtatgccagacaaggacctcctaggtgccaagagggcaagttgtaaaagactgtcacctgactccacactgagcttgttaacatttggccatccatggaaggcaactgctgaaagagcactaattgtaacatacccctagatgctaccatgggtctggagcccaaaagcattcaccctggccccagcacacactcgcctgcatgctccccctcccacaagcagctgagtaagtgaagcacacccaggtcgcaaatcctctgaaggggtccagggagctctcccatctccctaattctgtgttagcctaatttgcacaagttgataaataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtgaagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaacctttctggaatctcccaagtatattcatggcatccagttctctagcattagcccacctgagtggcatggagaagtgttgtctctaccagggcctgttgtctcctctgtttgtatatattgacacaaatacagtcattcagtagctctaggacaacggggtttttccaagttatttgttgtgtaaaggttttttgtaatgatcgccttctctatgcacttacattttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatcttatattaactataagagccataggattaaaataagttggaacagtattctggttttgtcctgcagaaaacgtaagctttggttctggttgccgtgtgacatgatttctactaaatttcactgaagctccacttgaagattgtgtctttttcctttttatttgtgttgattttcattttctattgtttcatgttttaatagtgaggagttgctattctcattgaactatactatactgatataaataaatgaagcttaatacattgcataaaatagtagatagctatattaaataatttttggaaaggaattgtgacctgtagaacttactgactttaagtacagcatgaacataatatgcaaataatgcttagttcctactcataaccagagagttgggaggaaaggaaaaataaagagtgagaaggatttttgaaggccgtggcaaatttagtctgcatgaaaagcagaactttcagaatagaaattcactctgaaaagaggcatttacagagatagtggaggcccctcttatagaaatatttactgttgtttttaacttagcacctaagtatgcttttgaatcataacacttgaatgagttctggaaagttaaatgctccaagactgtggcaaaaaaacctaccagctttcatcttcctcctttccattcccaactttctctagtactattcaaaaactccctaattaggaattcctttgggaaattccaatatcagagttaactagccaacctattattgctaatcatttattcctaccctctatataaagatgaccagcatgtgtgcacacacacacacccagacacacatctccctataccgttttctttttttcgttcattttctttaaatttcccattatactttttaaaaagtaatattgtccaaatttatagcactgtagttcttggattgtttcttattacttttgcatcaagcaagaaatgatattcagaacacttaaagttctgattggtatggtatagaagctgcatttcccacagtcacaaagaaggtcatactccatgttaataccaggtagtatccatcattagcctattagaaggtactgatagtcacctggaattcacctaccataatgatagtggcactggcaaaggcattgtctcatccactggagtctgggccagtccctagcagtgaacattcacaggctgatattcgcagacacctctcatgaactcaagggctgcaaccatggttggttagtcaggtggcttaggacaaagactttttatgtaccttaactattttattattttaataattaataagagcgtatcaatgcataccatctatatatcagccccgggtatagtgacaaatatcttatcttgtataagtactatttttcataccaaatttgctaattattaagagtcttcacagttcacaggatttaatcttggtgaaaaaggaataaactaaataataacaataataatagtccaaaatcaatttgataccaaatcaatcaataaagtgatcagagctttaatgctactaggaaaatacttcagctttaccattttatgtttcatttcaataggcaattaatcaaagttaggaaagagtgagctagcttttctcctggaaatttcagcacaggccctatgtatcatattatttcactaattagaaaaaattttagttttgtgttagtgaagatggcaaagacaaaacacacacgatatttcttgttaattgagaatgattttgaacatattctcaactactattttgcccaagatacttcattctaaaagatgtcatttctgaataaagagcacatgcaataaaattgcatcagaaacagaatccctcacataatattcttacaaatttaacatcactttagagaatagctattgacttttgtaagactttattatttgttcattcatttatttttttattcaacaattatttgggttcatactgtgtgagagaagacagtaagattagaaaattgttacaagagagatatacaaacagggcagtagaataagagagaagagaaagatggttaaagaatcttcactcaaagttatctggtgatcaaaatctgagcttgctaggcaaatggaggagagaaagcacatccccaggaaagggaaaagtttatgtaaatagagagaagtctatatggggtatctgaacaaggggcactaacagatcatacagatctttagtcatacccaggagggctgggtatggtggtttatacctgcaataccagcacgctgggaggccgaggcataaggatggcttgagcccaggagttcaagaccagcctgagcaacgtagtgagaactcatctacaaaaacttaaaaaataaaaaataaatagctatgtcaccagaaaagggctcccaatccaagagaccccaagagagggttcttggatctctcacaagaaaggattcaaggtgagtccataaagtaaagtgaaagcaagtttattaagaaagtaaaagaataaaagaatgtctactccataggcagagcagccccgaggactgctggttgcccatttttatggttattatatttcttgttatatactaaacaaggtgtggattattcatgatttttctgggacggggttgggcaattcccagaaccgagggttcctcccctttttagaccatatagggtaacttcctgatgttttcatggcatttgtaaactgtcctagcactggtgggagtgtcttttagcatgctaatgtattagcttataattagcttataatgctaataattagcttataatgagcttataatgctaataattagcttataatgagcagtgaggatgaccagaggtcactcttgtcatcatcttggttttggtgggatttggccagctttactcaaccagttttatcagcaaggtctttatgacctgtatcttgtgctgacctcctatctcatcctgtgacttagaatgcctaacttactaggaatgcagcccagcaggtctcagccttattttacccaggccctactcaagatggagttgctctgattcaaacacctctgataaccataccaaggactatgagttgcattctgaaattaatgggggctctgtgaacaaaggcagtgagtcttataatcaaatgtatgatttataatgtttctgggaggaaggcaggctggaaataatcagaatggcctgaaaatgattgcaagttttggattgactataaagtaaggtggcatggtggctgaacaatgctgtgctggttgtgtcaatatgagtgtgagctgtgtcagtatgagtgtgattgtatcaacatgagtgtgagcacctgtgggtaattttaaataaaatgtgttgaaaaatacttgatttttattgaaaaattgcataaagtagctactcaagtatagagtgtttgctttcacatatgcatatcatgttacctacatgaggcaaaacaatgaaaataactggatggctgtagaaaggttttggagaaccattagatttttttaatgtttaagatgctgccatctagtgacacttttgtgaaatcactttgcagtgatattcatgtttgtatcttccagttcttttctcaatacattttatattttaataatttatattgtctaccaaccaatggggaaataattacaaatgcattaaacatagtgtagaagtcatacttgatttttcaacgtggtaccacaaatgtggccagaaggattttcataatgggatattgtacataaaggtttgtggtttcttcagtgtgccattctttataagtaattgataatgaaagtgctgctttttctatttcttgagttttcttagaaaaattgagttgtaaaaacaaatctgtgaaaatctgagctgtaaaaattgcttcataaaagttgctttaattggaaatgttgaagagaagaaaagagagtttcaaatttagaataattaacttttttccccatatggaatttcagtattataagtatatcttaaaatataaacaaataaatgtgtgtggaggggtgtgtgtgtgtctgttaaagctaaacattagtctccaaacctaggttgtgatgacctgatgacttctaagttttgatgaagattaattatattcatgtcctattactccttaaacttatattacaatggagcacttgtcttattttcatggtacgtattgctcattttctttggtgaggaacaaagaataaattaatctcccttcctccctcaaaatacagttatattgtgctgatatattgtccttttgtgagatactaactccagtcatactatagtgaatgaggttttaattaattaacttttcagtatattgaggtttctttatgcaaaccaatcctatagggtagaggtaagcacatctttccgtaaagaaccaagtagcaaatattttaggctttgtgggccatatggtccctgttgcaacaactcatttctgctgctgtagcgtaaaagcagccatggacaatatttaaacaaatgagactggccgtgatccaaaattaaatttacagaaacagactatagtttgcatgtctcttctctagggaaaacacctgtatttgtaatttggggttctttttttcttaggaagtgttagaacacttctaaaatttatttaagtatttacttcaaaaactttaattccattgagagttgtgtgccttcagtgttccaaaaaatctagtttggagcaggtatgtgcacttggtaaactaatcgtacacatagtaaactacacttggtaaaccagtcatacacaaacccagaggtaaaatgttttgcaaagttctatcacctgcatttagccagtttttaaattcatgttcatgtacaaagttgtcttaatgtggaatgaatctttatattttctcagtaaacattgcaacattttgatatgcagtaagttaaatgactttgatcatcagcaaataaattagaaacttcctacttgggtacaatttggataatatgtattcattgttccagtttgtgcttctgggaatttagtggaaacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaaataacatgggcgcaagagagggcagagaagcagaaccattgatagaatttataacagtgtatatacttgaactgattaaatatgcacatgatgtgggattaaatgctaaacaagaaaactattgactctttcatattactaggatacacttaagcagcagttcagaaactttttagaaaaggaaaccttttacactcttaaaaaccactgagggtcttaggagatttgacattggctctatatctgtatttactgtatttgcaattaaaacaaaattttaaaatgtatttatttgttttagaataacaacaaatgcattacatattaacataagcaaaatattgttatacaaactatgttttctttaaaaaacagtagcattgtttatatatggcaaatcgtattagcacctgacttaataaaagacagctggttttttatacctgcattcaatctctttttttctctttttgaatcttacaaagaaaataggcactcatgaagatatgtaatcagaaaaggcaggagtagttgaatagcctttccgtcaattttgtgtattctttgatactgcatcagaatttgacaagtgagaactttttaggagttctggtatggaatttgaagctgaatcactgaactttctgtactttattatattaaaattcattgactgaacttgcattttgaatagatcctttatcaatgcacaatatgtaacatcgagcattggccattcagaaaatattggttcattgaattatgtgtattttccaaatattgacatatttaatcatataataattagaaattatgtattactactatattcatcagaattatctcaataatgggagctagtcatactcatggaagtggatacaagtttttcaatattctaatttcccctggaaactctaattttatcattggcagcaaatattataagttgttttattgaagtgacactccattttcaaaagaatatctgttaaatacatcacacatgtgaatcgtcattgtttgtcagttgctctttcatgcagaaatggttgtccatgatataaaagtggcaggttcagcttgccactcaaataattgcataaatacattgctttaagatagccatcctacatcagaatgtggtcaagggttttatgtgtacttcccacactcaacattaaaaatatagaattaagatattgagatttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcatcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaattttaaagatttgagttactttccctatttcttttattgtattttctgctttttgttaatcgagttatatgatggaatagtatgataattaatataattctagtatttctatcaatatagagaaattaattcttcaattccttggctgctatgaaaaagtcaggaggttctgtagaaaaatccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccagatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaagcggatggtttaatgcaaagagaccacttgaatattttttttcaaaaattagactttagaaaatttcagattcctcacgttgatgaataaatcaaaggcaaccagagctgtgcctaatagagccttaaatgtggcatgttattattaaaattacatctacctttaaagctgtaaatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatataatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctcacatttctgaagttctgtgcatataaatcctaggaatttaagatgattttctatagtttctttaattgtgtctaaatttttttcaaggttttaaggttttaaacttaagacaacatttgtcttaagtttaaatatctttggacagatatttagtcaaccagacatcttacttgaatatcattatcagtacattagatttccctccatgtatgtcccaacatctctgagaagattaaaaagcaaatattataagaataccatgttttccacatagacagtatgtaagatattgcttgcttttgtatgatgactcacaaccctggccatttctcagtctccatttatttaaattgaaatagaggatctcatgtattatatcaacccaaagggtgagccagtgcccggatagaaggaggtggggtgggggggaagaagtaatatacataaattctagagaatgtcagtgttcggagttaagctttgacctcctagcacacacaggtcttgtacttgagatttctctcagcatggacaaggaacaaggacaaagggattgtattgtgctcacatatgcctcattttgtggaatttcaaaatcttctagacaatgtttaaatctatgttaagtctaagctcccaagagaaagaccatctaggcagaccaggttcacagttcagcttggtctttcaggggtctgtcacctggagaatcttctatgattgttcagtattctggtctctgagctgaggtagtaccagcccctactcataagcagttattgtgagaataaaatgagatgatgtatgtaaaacactaagtgtatcacttgaacatttaatatggtttggatttgtgtccccacccaaatctcatgtagaattgtaatccccagtgttggagcaggggcctggtgggaggtgatgggacaatggggcctttccctttgctattctcatgatggtgagttcttaatgaaatatagttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataacatttcttctcatggtccactcattcactctttaacaagtattttgaagtatatatgtttgaattatgtgttcttctttttgacaatttgactatatgttgatagtgcaataattgtgcagtttaagccttcaataaagaggtagaatgtgatgaaaattggaaggaaacctgagggggcattcttagtgcttggttaaacagaaagcttaacagttcatgaaggctggtctaagaaaggaattataagcatgggtgacccacctggtgtagagagtgtatccccagatatataacattgcattttagaagtctaatatttggtatataatttttgaaatagtcctttatgtgatgtttccattagcaaacagcaaattgcatctgtaccaagagatttcacttccttttttgtttaaatatgcattttggacattgttcaaaacctatgacctaaggcttttccaagagccctttgcccataaagagaatgaataaattagaggccagagtcaacgcacggcattaagcatcataactcaagctgttattctcacctagaatttaaccttttcctagttcattattaacttagctcattgcaatgtcatattctaaactctgtctgtacaataaattaggactggtcatgacttcttggatgtttttgccccacttcaaggtagactttaattcagtctacacagttaattattgctctgaaatatgaagggaactactcttaattgtacaaatttgacaatatgaaatgtttcactaaaaacatgcttaaataacattgtaaattttgaatgttttaaaaaaagttacaaatgttaaccctcatggcacactttagaggactatttaacctttcaactttaggggattcaaagctttgtgaatcctttaaaaggattcttctgtaagagcccatacattgcgatttaagataccacctccctctttttttgttaatagagagtctactatgaaaacaggagtggataatatgaggtattacaaatccatctatcatttacttttttatgtgagccagtgaaatcatacatactgaaaacctgctgttcctcactcttcacgctggtgtagcaaacctccacatgtgcccattgtattagattctcctaaaatgcacatttcccttgggatacttttcttctgagcttttttgaatgggcaagaatggggccgactgacaattttgataaaaatacttgaattttaaatcatgccaacacatttccataatcagctagaggtatttgattgaaagttttaaacagtgatgacattttaaaggccttattaagggcttgaattatctcctttattgtaaagagtaatttgctggtgaaaaagaaccagttgaaaaggctggctgacttcagtgcatggttaagaaataagagttgttactatttggcaacaacattagaaaaacaatatgcatcaaacaattcccaggaaagtcccagaaagaataaaaataaacatccagaaatttcagcaaaaagacttaaaaaattataactttataccatgcttgtcccaactgtacagttaacattgtatgaagagatcgtcttttgcacatttgttcaggggaacactgacttatatatttcacttccatatgcttttccaggcaacagttgagaatgccatagcccaaaacttatctataatttaaatcctgttttagttttctaatgatgccttctgaattactacttatcaagtccctatctagtaccagaataaggccttcttgtgcaaagtttgagacaacaggaagcataggtcgcagtagcaagatgtgtgacttcacaacacttctgatgctttcaaatgagatagaccagtaccaatagatttctcagtgagtttttatagaatccccagttgaaatatgacctcggccttctgagtcacctgttctgcttgtttagcctgtatttagccagtgttaatatggatgactttccagctacaacttcttggcttctcagccatatataattggctatctcctttgtctttaatatttgcctcccacatctctaaacttctgtggtaccgttttcttttgcttctgctccaatggatgtgagaactcttctgtattttaaaatgtttactttttcaccttttcattgattctctcaaaacctcagtccttaatcctcttgcccaaaagtatctcatccacagttatttcaacaatatacaactggtgtagaagaaacgaacttttatttccagctttaccacttgcataatttttagcccttattttcatctgattgcaaattgcaagagtttgtcattattcaaacatgatctcagtccccaaagatataaggaaaatattcactaataaactccctgcttgtaaaattagtccttacctgaacatcattttccaagtagcagcatctatctctatgaattactctacaaattcttagtatcttgctgattatataatatcataaatatcagataatacagtgaaaatataatgaaaatgattttaaagtaagatttttcaagggagattcaggatgtcatgatgcaagtgaatttggaaaactcctgaatcacaaaatcatggctaatgataatatgtcagagcagttaacaggtgaagtagaggacatttgacaatgtacttcaaaaggaaataactggaatatcaggcattcaagataaatgataaatgcctcacaaatctatgtaaaaattatctttaaggtcatgctgagaaagttaagtatactataaaagggatgatattttgctaccatatcattttgtcaagaaatataccaaaaaatcaacacaccttatccttattcttaattattagaatattataattttaatctatatttctccaaatcatatattaaattttaaaaataattttaagctctatattttaagatagcatctctgtcaaaccttctgccattgactttaaaattgatttatttaagtggttttttcatattttcatttgtcatcagatattaaggactttggatatgtctgtatatgtgtgtgtatacatacacacacacatacatctttctatctcagaaactaaatatggtaaaacttgcattttatctcacataggtatctttctaaggtaatcttcactttctcatgtaaagagaatgatcctgagtttattaaagagacatgaacaaacataaccaaccaatatttttgtgcaaaaagctttcatagatgaaaaataaatataggctattgcctgcgattttaaaatgttataattcatttggagatatatcttttaaccagttaaataagtgatttaagtcacaggcaacccaagcttagaatatgtgccataaggcagcctctgattaattactgggtgaattctcagactgcttttgccgtaggggcagcggaggtatagcagactgactcagagctgcttgggaagagcttgagcaaggaggtggggaaactcacagatacgaatcttctgtaaaatggaatgcaatactaactaagtgaataaatttactttgttacattgaaaactaaaattgttgcctgtgagagagattcatttcagaagttccataaatttaaggggatataaaaaagaagaaagaattacttaaatggcatttcttaaaggaatatgccaagtgatcttttcctttttattctcctcattagaatttttatggaattggagttattgacttaacattttaaagcctgcctcattatcataaaattgttctttatctttcaacaatattttagccattataaacagtggtaaaatcgtgattgctttaagctctcccttcgctctgggaacacactcttgaagtgggttacacctgtcatcagtcttagtcctcaaatggtgactgtaagggacccaaaagtagacacaccacttgaagaaaactcatctgtggaatcatgacatacaacctaaacctattttcatttagaaaccattttagatcaataatttttaaaggatttttttaaaaaatcttcctggcttgacaatttttactgtgtgaaattctccagataattttcttgtgtagggaatttaagctgtgatcataaaaataacttacatgcattgaggcacgagcacagttaaaaataaattcagtaaataatctgtatttttttaactccagagatgaagtaatcctagatcttaaagaaagccaaaatagtaattatcagtataaaaacatacattaaagctattcttgcttgtaaatcgctactctcagataatgatgaaatagtcattaatttgagaacactgaagtcctttgaaacctaaacatttattttctgttctaaaactgcagtccagtgtctctgaagatatatagggtcaatgaacctttcaggcataaaaagtaaaacttgtcaaagagcttcagctcttgttttaattacttcaagttttagccctaaagtaacctttgaaatctgcagggactttatttttttttcttactattaatcgtgaagagctattgctacattttcatgtgttcttgtttagaacatacatgtatccatctggctttttatgatttccaagcagacagggtggaagtttgttgtaataatccatgctgtgtgaagcagcattgcgagctgcctcagcaacacagaccaggtaccaagtcctggtacttccaacactgaggcaggctaacttcacagtctacacaagaatacttggaatatattactcacaacaaacttctaaaccacgtgatccatattctccatgttcacctgttttgctcttcaagaggagagaatttgattgggtgggaattattcttttgtccagagctagcatctattgtcctcatgaccaactcatgtatagatagcttgctttgtctcccatatcagtccctgctccaatcagctttggtcaggatttaagaagatttcgcacaagccatggcaatttaggcagaaaataaccatgtggcactatgttttttaagggcccaatgatccctatgaaaattcattttagcatgtcttatatggttgcttaataagtttattatagattgaaatcttaattctaaattctttgagtcctgggacattgtcctgttaatctttctttactttcataatctacagtgcccaagaaagtattttttaaatttttgttgttgaatatatggctctgtctttactctcagcataatagacaaaccatcttctagcatatggaagcatttctactttgcaaattattctgaagcgggtatgatttgcaaaatactgtcaaattaaatatgcatttccatatgcttctatgaagaccaaatatatccatgaaaactagctacagacaactttaaaatccttcatgaatttttaatcaacattgatgaacaaaattcaagtcgttctttctaaagtcctaaatctagaaaactttctgttcttggacttggagcatcggtattaactcaaaggattattttaccaatatttcaaaataataagatatttcagaaaagtatattcagaaaatgttcaaaggcttttttgttactaatagtctcatgccaaaaaacatattgacttagctcttataagaacaacatattctgaaactttagaaaacaatttttattaactaaaatttatcatttctggaagtgcttttttatgactatgcttatcatactgttagcttactggacatattagaacaagcctcttacagagtaagatttgaagaggtaattgaatatgtaacagaaccaagtgaagcactaatatttacagatgggtgggcaaatgagaagaaaaaaatgaaactgaattttatgatacatcctaaaactactttctaaaatagcattaagtcagctaacttcgaacaaagcagaacaattgtgattagatgaatattttattaaactaggaattgatagagatctttttaaactaagagtatgttagcaatattgtacctgtttaatggcatggcatgccatgccaagccttctaatgggcatgcttggggaccagttgctggcatcaaggggtgaatgtacagtttatgagctgaagcaatctactttctcagttttcaacactttttctttgtcattagtacctttgaatctgcttttgtcacttagccatacttttgtttttcctaccgctatgctgattaccaactgcctggatttagactctgtttgctccttctctcattgttttttgttttgtgttgttttgcccacttgttttgatgcatatctactgttttgtctgattgtcattttataggcactagttcggtgttctctatatgtgcctgaactactcttatttctgaactcaaatatctgcttgcactgtaccaaacgtgtctctgtttcctaagcctttcttctcactacacatggtagtctagcaacattaatgccctaccgtgggaatatggctgaagatcttgactaggggacttatgaacccatgcagccgtgcccaaatcctaccaaactgaccttactttcttgaagacggaattgtagtatggtcgagctcatgctttttgtagtaggccatccaaattcgattgactggctaaaaaagattgttagtggaggctggaagaaacattttggctgatgatagatgaatagagcttggaacaatcaaaaggaaaagcagaaagtctatacctattcataagaaaaagttagtatgtttaccgaacattatgaaagaattatgacattttcaaagttttaaaattttattttgtagggacggggtctcattgtgttgcccacgctggtctgtttcttgaggatttactatagactgggctgtattcaaagcattggggatacaggcatgaatgagcccccattgtcctgaacttaccattcagtctgggcagtgaaagaagagggatgttgggagaaccttacaaagatgaaatgtaagctaactggagaaatcccctaactttcagtcagactgaaagggaacaggcagtaactgtgggtagccctcttgggcagggtgattttccacatgtgccagtcaggggccagaacattaagatccttatgttccaactaaggaattttgattttattttaaagacaaaggggagccactgactgttcatgaggaacaagattacaaattcaggtctcttcacctctcattaagtcttggtttgcctgtggaaaaaataaatagaccccagtgatctctggaagattctcttccagctttcgaatgctgtcattctcaagtgataaaaatgaagcatcacaattgagtgaactgctggtagtgatagctcagaaactaaaaccagcttgatggaaatctgagcatcaccggctatatcaataacttcagtgaccctcctttccactcctttctgtaataagtgcatgcagtaaagtacagccagttcagacaacttgataacaaatttgctataacattcttatctttttccttttctcaagtatgaatgagtactatgtatatatttcttaaacttcagttgctaaagtttttactgtgaatattaagactatatcaaagttatttaaatggataaatttccaattgttctctaaacaaaacaagatttgtggaagttttgactctatgaaccctgattatttaatgaggaaaataagtaacatacttcagattaggttatagaggatgctaggatgacagacattctaacttatcccaagttgttattacagactttgtttatttttagaataaacaatcatgctgtacccagcatgttccatgtttttgcaatgctatgacaatttgtctgatcagcacattttttaaagccaaggaaacagtaagacaattatatttcattttaagttatagcctttaggaagagagagaagaggaaaagaatgttcgcattcctgaacacaaacttaaattattaaatgtatggtaataagttgccaaattaaagaaacttatgacagcagtcttctatgaaaatgtatgttcttaagaaagattgtgaactatttttattatattttgatttggtgccaaaggggaaattgttctttaacataagctaagaaacagatgtttgttgtttagtttttgtgaggttgaggtgagagataaggggtttaaaggataagttaatgaatgacatatttaggaattcatattgagcattttgctattaaagacttgctgaagagatcaaggagagtttggatatttcatttcataactcctcacatccgaaatcatattcactagatccccagtggctttctcttactgaatctgagtatcatgcttcaaagatgtctttatgataagcgatgctttccatttgataacatttatttgaaactacttttttggaatttatgatgttcaaagaacacacagcatattaatatgtctgcttttattatttactggatctcttccaacacgttacttctctcaaattctgtttatatctccattcttagtaaattaattccctttttgatttttaatttttgatgagaaaacatttgaatttctagtccaagcacaaggagattgtatcttaattgttattgttgacatttagtttttaggaatgatttatgagcccattgtgataatagctacttataaactaattcagtggtttttaattttacttcattagctttcaaatatttgctttttaagaatccaagatttcattacgattgcatttcttttgtgtttggattttacctttcctacattccaagtgatggatcttaaaatgaatttaacttcctcctagattctgtgcaatgtatttcgtgtttaaatgttgttttgaaataatcatttctttatttgctttttaaaaggttttaaacagcgcttatttctgtttgtaaagacttgaacttgtaacagatgagtgatatgcttactcaagttcactaaatcaagtgtctaggatcatgcattttgaagaaaggcaactccttatagagattctaaaagaatagagaaggtcaaaagaacatttgtttgagggagtggacattgtatatactaaaaagaatagcttctgtgaccaggcgcagaggctcatacctgtaatctgacactttgggaggttgaggagggcagatcacaaggtcaggagattgagaccatcctggccaacacagtgaaatcccaactctactaaaaatacaaaaaagttagctgggtgtagtggtgcatgcctataatcccagctactcgggaggctgaggcacaagaatcacttgaacctgggaggctgaggttgcagtgagcagagatcacgtcactgcactccagcctggcaacagactgagactccgtctcaaaaaaaaaaaaaaaaaaaaaaaaaaaagaatagcagctctgccatcttagcctattctagtctatcctagcctagcattctgccagccccaaacccggaagtagtctggagaacattgcttttattaaatcactggttcatttttaaaaacctgctcccgatggttttgcattttctgtgaatatcctgggtcatgatggtctatatctacatttggactttaacaataaataactgtggaatcttagactatttatcaagaattttagagccttcatttcctcctttgtattataatgtggataatgatagtataattcataggattattttaaaaattaagtgattgctttgaatggtgtctggcttataataaaatctcaattaacatttctttttgttggtctcaatattattaaaacaactaaaagaacctaagtggaagaaaaatcacacatgctctaagttaaacttgtttgattatttttataagaccttagctgagtgtttgaggagtcatcaatcacctagggtcaagttgtgagctagcaattggaagataatatgggaaacaggctctctaatattgttttactaaatgtaattattttttattttcttatttaaattagtaatgtttttcaaaactttagctaaccatgtatcagtatgggctgttacattaaaaatgtaatatcattgatgttgttcgtcatgaaaatattcagaatagcctgaaaaatgtcatacatcatagaagagagccaacatgtctttatttcacaaggggtatgggtaaaaataaattttaataagacagaaatctcatcttcttgttatagtaatccacttaaatgattaaatttcttttatcaaatgattaaatttctttatcaaatgaacatgtagagcattcatcttaccaagttgcaattttttccagaggagataacatttagaatttcattaagattgaagatcaaaaccaccaattattaaaataacaaggtaattattaatactctatatccaaataaagacataaaggaagaaaaacatcatatgaaaaattagtgacagtccgaaataattagctaccaatggccccaggactttatagcacatataatacgaaatattccctcccctacttttctgttgctacatggcagaaaactatgtgagtctgtatttatgactggttgaattgttttgatgaatattttatttaagtaattgctatgaccactgaattcaatgatatcactgttacatcgagatattaatctttatgccatgttttacagaaaattgtattattttccacatccagagtactctgactccctttactactcattgttagagaattataatataaataaactctataaagagcaactattttctttattctattgatcttactcttattgaggtcaaaatagaatacagagacaaatctctaaatttaacattttatttgtgaatcacagaattgcaatttggggcacacatacagatcaggcagtcatcagcatgtctaaagaacaaagaaaatgttggggtatttattttaaagaaatgttacatatccttttgaaagaaatctctctggcactagaaaagcttttggaagctggcatatctctaactggtgagtgacagtggtaggtaaaactagtcttagttatagcaggtatttcagcagatactaagtgaaactgggcttcgggttacagcaggtagtttcagcagctgggcttgtggagaagtcaattcttggagcagtgctatgtgccctgggtgctttttttcctctggcctttagactttgatttaggtgagtatgacaagaatgacccaatttgtataatcagcattcaccctcttctccccttgtaattgcttcaatattcatgtcgataaaactgaaacatcttatcttgagtctctggtttcatatccttcagtgtttcaatccacttattgcctcactcatgatgggatatgtcagcactttgtcttccttaagtactgactatgaaaatatcagacacctagctttgactctattttccttctcttcattctttctatctcactttgtcccctggattgttacttcttggtgtggagtcacagatcctatctaggcaagagggagtgagttagacaaaggcatgaacactaggagggcactttaagagtctgcctaccacaattccattgaatatacttaattaccccctaccccagccatcctcacacccaatagactttaaactattggacagggatggtgggcagagacaatgcctgttttgtcttatgctgtctctctcgggcttctagcaaattgtctcattaactatttttggattattaataagtgaaacataagaaaactctaataagcctccaaaaagaaggataatttaatcaggagcataaacaatagatatagagcccttagtaacaagtatcaactgtagagttgttaaaccattttgctttactcagccctacttttcacctctgctcttccattcagtttccagggaccgagcatctcagcttctgctttcctgctggcttgttaagatactcagttttactccctccttcaactttgttctggttatgctatcttgatcacagcttcttgcttgtggtcagtgttcctgattatttattgagcaggacattggcttaactagctgtgcccctttggatgagtcactcaaccactttaagccatacttttctcaaatctaaaatggtagaaagaatatctacctcaaagtggtgttgtaaaaatttaagtgagaatacaggaaatgactatgcccatttcccagcaaacatgtcttagtttccatccatttttccttagcagctagatgtgcagaagctttgctaaactattccttttgaacaggatttcttattggcacaggagccaataatttgattcgccaggccattcttaaatgttctatgggattttatagcttccatacaggggtaatagatccacaggtaatggggatggggaaagacaatggatggcaaacaattagaatcttcggtggagctggttcaaggtccaggtgctctctttgtgtcctttgtacaaagctggcggaaatatataatttcttaagtgaataaatgcaaaaaagagatattagcatgaaataatgagataggcaacttggaaattctttctttgtaaacaatcatattgtacttatactttttcagatataaagcacttttgtaacttcagtaaataaaacattaataaaaccccaatgtcttgaccacagttacggaatcagttctgagttcttttttcctaagaacacattttactcttcgtgtagtcccttgtttctttcatatttgggttatgaaaatgtcatcactattttcaagcacaagttattatttcctcctgtgatactgtttgaacgctaggtctttgatgtttctgtcagatatacccagcaatcatcatcataactcatactcttgaatttttaatatcactccacacacagaagtgtcaagtacccagttctttagtgaatgcacaaaaaatgaaagaaaagtttgttaaataagaagaaagattgaaatactgaaatattcctcctgatttttgttttgatcccattgaaaataaatgggaaatacatgttgctatttttttcattgctctgtctcacagccactgtttgcatcagatttttaaaaaagaaaatgccaagcagtacattttgaatcagtttccacagaaaacattatgtgcataaaatttcatatattatctttgatatgtaaatataggagaaataagtttctttggtaaattttagcatttcttcttttcaaaaaataaaacataaaataatagtcaatggccctatggttgtaaactatggtgaatgcatctgattcatttatgctagaactccttccttatttcctcctttttatgcaaacattatcttaccagccttaatgggggagtcacaataagttcccctcagtactcagcacagggccatccatgcttgcggaaagaatgggctttgaatatacatcatgataaacattagtacattaaataagcaattactttctaagatgattttgtttttctacacaatttaactcattaatatagctcagttatctgttcaaattaacttaagatagctgtccaatcctgattctgatatttaatacaaaaacacttctttacagctggggggggtggctcacacctataatcccagcactttgggagaccaaggcaggggaatcacctgaggtcaggagtttaaggccagcctggccaagatggtgaaaccccgtctctactaacaatacaaaaaatcataataataaaataaaatagccaggtgtggtggcgggcacctataatccccgctattcaggaggctgaggcagataattgcttgaacccaggaggcagagatttcagtgagctgagatcacgccactgcactccagcctgggtggcagagtgagactctgtctgaaaacaaacaaacaaacaaacaaaaaacacttctttacaagactttggtattcatacttcaaaattttgtcattaattttgcttgtctacagaaatttgattttttttttctgtaaaccagatgatatgggttaggttagggtctaactggaatatgaaggaaggagtagataacaaggccattttgaagaataaacaacaaaattaataactgataagactcaaagagaagagggaaataacctaatggtgtccaattcaggtgtctaaaactacctaacagaaagagtggagctgatgaataaatataaagaacgctgtgtttgacatattgtgttttgggcagaggcagaactagagaatagggcttctgacttctaatcgaagacattctcctattacttgattaagatcttccatgaacaaacatcactttcatttactttaaacttccagaagacagattacttaatatgcctatcattttgactaattcatgaaaatgtaacaaattcattagatgataggcttctacatttccttccccatgcattaattttcaactgtaaggtttaagatgaataccagatatattcaagtagggagggaatctaactaatgtttacaataagcttaccttgacaggcactgtgctagaaacttcacactttgtttaaccataggcctatgaagttatagatgaataaactggtgcccagctctctactggtagaaagttgtgggattgagattcaagtctcaggtccagtaaaatcttccttgtcagctctcaacatggatagttctaaatgtgttgaagctgctagaggaaataaaaaataaaggcagcctggaatggttgctcacacctgtattcccagcactttgggaagccgaggtcagtggatcacttgaggtcaggtggtcgagaccagcctggccaacatgatgaaaacccgtctctactaaaaatacaagaattagctgcgtgtggtggtgtgcgccaccactcgggaggctgaggcaggagaatcactttaaccagggaggcggaggttgcagtgagccaagatggcaccactgcactccagcctgagtgacagagcaagactctgtctcaaaaataaaaataaaggcaatattcatttttcctcccgagcatacaatactatctttactatcaccaatgtttcctaaattctagttaaactaggtactactaacttaagcacttagagtgatgaaatcatatctcattaggtgtcacctggagggaagttaatctgccatcaccagtatctaacccccctctactaacggggtcactagtattattttcattggttgggtgccatctgatccaatgcatcaccaatcaaatcacctcaaggctaacataaattgtgttttctctaaataaaaaccaacaaaaatatcttgccctagcttaagctaagagtgaggcttcctgataagtaggtcatccagactctagggatatgttttccccatgttggatggaaagatctaccctgtagtggagatgtgaggtatttgacaagtgtaatagatgattcaagtctgacactagcaaattcattaatactatgatgagactgcagtcacagatggagagatcaatccttcccccaggcactgtctaacactgctttaaagggtagaaagcgaaaatgacctacctggttgtgtctaaagtttgcttagggcagtcacatttcactttaagaagtacctgtagagctctcatataccaggttccatgttaggacctaggcatgcaaagagaaacagaacaaggccctgctcataagagtttccagcgacctagagaaactggaaagaaaatagtctggccctttttgtcaacaagtcacatgtgcatctataataggagtgagaacttgacgaaaaaataagaagaaaggctcagtcatatgtcagtaaatttcccgggaaagcagaagtatacaaagttgtatgtttgcaatagtataaatatatatagcataaaatagtataaatatacaaaccttgtatatttgaatagtacattatttcccaagtatttttgttatgattaccaaagagaaaaaacctggaactatttaggttggtgcaaaagtaattgtggtttttgccatggaaagtaatgacaaaaaccacaattactttcgcaccaacatgtaatatttctgggtagagaatgatagattattggtttacaaagaccagtctgaatagaaaaggatggaaagcaaggtaaagtttgctgcagtctaaagctacaagtacacattgcttcagttcatgctgtgttccaacaatccatggaagtcctcagaacccaaatcactgaagctgtaagtagagtctagaatactaatggctctgggaggaaatatccaaagtcactgctgattcagctagagaaaatacactggagggaggagccaagatggccgaataggaacagctccggtctacagctcccagcatgagcaacgcagaagacgggtgatttctgcatttccatctgaggtaccgggttcatctcactagggagtgccagacagtgggcgcaggccagtgggtgcacgcaccgtgcgcgagccgaaacagggcgaggcattgcctcacctgggaagcgcaaggggtcagggagttccctttccgagtcaaagaaaggggtgacggacgcacctggaaaatcgggtcactcccacccgaatactgcgcttttctgattgacttaaaaaacggcgcaccacgagattatatcccacacctggctcggagggtcctacgcccatggaatctcgctgattgctagcacagcagtctgagatcaaactgcaaggtggcagcgaggctgggggaggggcgcccgccattgcccaggcttgattaggtaaacaaagcagccaggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggctctcccagcacgcagctggagatctgagaactggcagactgcctcctcaagtgggttcctgacccctgacccccgagcagcctaactgggaggcaccccccagcaggagcacactgacacctcacacggcagggtattccaacagaccctgcagctgagggtcctgtctgttagaaggaaaactaacaagcagaaaggacatccacaccaaaaacccatctgtacatcaccatcatcaaagaccaaaagtagataaaaccacaaagatggggaaaaaacagaacagaaaaactggaaactctaaaacgcagagcgtctctcctcctccaaaggaacgcagttcttcaccagcaacggaacaaagctggatggagaatgactttgacgagctgagagaagaaggcttcagacgatcaaattactctgagctatgggaggacattcaaaccaaaggcaaagaagttgaaaacttcgaaaaaaatttagaagaatgtataactagaataaccaatacagagaagtgcttaaaggagctgatggagctgaaaaccaaggctcgagaactacatgaagaatgcagaagcctcaggaaccggtgcgatcaactggaagaaagggtatcagcgatggaagatgaaatgaatgaaatgaaatgagaagggaagtttagagaaaaacgaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccgtcaaagggaagcccatcagactaacagcggatctctcggcagaaaccctacaagccagaagagagtgggggccaatattcaacattcttaaagaaaacaattttcaacccagaatttcatacccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgtgcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaagcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaacccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacatattcaaaagctagcagaaggcaagaaataactaaaatcagagcagaactgaaggaaatagagacacaaaaaacccttcaaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacagatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcttcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgccgaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacttagtgttggaagttctggccagggcagttaggcaagagaaggaaataaagggtacccaattaggaaaagaggaagtcaaattgtccctgtttgcagatgacatgattctatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactactttaaagttcatatggaaccaaaaaagagcctgcatcaccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcataaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcatggccattcaggacataggcatgggcaaggacttcatgtgcaaaacaccaaaagcaatggcaaccaaagccaaaattgacaaatgggatctaattaaactaaagagcttctgcacagccaaagaaactaccatcagagtgaacaggcaacctacaaaatgggagacaatttttgcaacctactcatctgacaaagggctaacatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggtggggggagtggggagggatagcactgggagatatacctaatgctagatgacgagttagtgggtgcagcgcaccagcatggcacatgtatacatatgtaactaacctgcacaatgtgcacatataccctaaaacttaaagtataataaaaaaaaaaaaaaagaaaatacactggttgtccccaaagcggagggtgtccccaagttggaggttctccaaaatacaaaatgtttcctgcgacaaaggagaacagaagaaagcagctatctcagaaggggctctggaccaggcacgatgactcacgcctgtaatcccagcactttgggaggccgaggcgggtggatcacctgaggtcaggagttcgagagcagcctggccagtatgacatagctccatctctactaaaaatacaaaaagttagctgggcctagtggtgcatgcctgtaatcccagctactcgggaggctgaggcaggagaatggcttgaacccaggaaatggaggttgcagtgagccaagatcatgccactgcactccagcctggatgacatagcatgactccatctccaaaaaacaaaaaaaaaaaaaaagaaagaaagaaaaagggactatggagtacaaaggcccatgtgtcatttcccataatatttttcatatttttgttttattttttactgtgtatatttaaggtctataacatgatgtatgggatacatagaagcagtaaaaggtcgctgtagtgaagcagattaagatatccaccttcatgcagttacccattttttttctagcaagaacagggaaaatctactcacttagcttgaatcccaaatataatacaattgtactacccatagtcctcatgctgtacattggagttctggacttgttcatcctgcatatctgctactttgtgtcctctgacctacctgtctgcattttcttccctcacacctgtctttggtaaccactcttttgttctctatctctgtatatttgaattttttttagatttcatacataagtgagatcatgcaatttttccatgtctggcttttttctttctttttttcttattaattttttagagacaaagtctcactatgttgtccaggctggagtgtgatggctattcataggtgctatcacagcacactgcagccttaaactcccaggctcaagtgatcctcccacctcagcctcccacgtagctgggactacaagtgtgtaccaccacacctggctctggcttattttacttagcataaggtactccaggctcatccatgttgtggtaaatggcaagaccttattattttttagggctaaataatatttctctctctctctccctgtctctctctgtttctctgtctctttctctgtgtgtgtgtgtgtgtgtgtccatcatattttcttttccactcatctgttgatggacacttaggttgatcccaaatcttcacaattttttgaatatgctgcagtgaacaaaggagtgcagatatctttacaaggtgctgatttcatttcctttgggtatatgtccagagaaggaattgctaggtcttatggtagctctatttttaatttctagaaatttgatagttttaaagaaaagttgcatatatgaatgttatcaggtcttgaatttaaatgagcaaataattttattttctttgtttttgtctatctgaatttaattctatcctgaacccacatctgtttcttgaaggaaatttggtcttgtaacttctaggtaagcttagtgacttttgttgtttttctcagtaaatttggagtttaagttctgttggttcagcattcttttcctttcctccacagaatgacattgcaaaggtagatgatatacagaacactcaggcataggtaagggagaggcttcggacccacagccatctcctggagtacattgagatgtgcttgtacccttttggtcaactgctctcattaccattacattctccaagatgtgtatgaaactgaaatggcctcatgccttttatcccaaccatcccaaagctccattggagacttggggtctgtcagtcacttctatacctatccctgggggagcaggaatttcaaaatagtctcttgcgtctttagaggatatagtatgaacctgggttttaaatggaggtgctatcacacacaggtccattctcctaacattcctacacaaagattatggcaccaatttggggcatgaagaaattctttacaaacctttggactgccccttagggctgagggaacatggctcaggccatttccatcatcagatcttctcaaacatatgtggagttcccactgacctctcaaccctcccagcctcatcccttggattttatctagtggtatggagtacaacctggctaagtattgggaacctgaatcaggtatgaatctcatccttttctgaggcttctccttccccagcaggagcaaatttggtttaattaatgggttagatccattgtttcttcagttttcttttatatgtgctgtttctggcataaattttatgctgggctatatgtaacacatgatttgagatcaaacatgtctactgcaaatcaaaagtcttggcttttagagagaattgtctctgctataagtttcagaagtttgttttggaactcaaagctaaaaattagaatttttgttctatatgcaccgtttggtgttctccacttaacaaatgatcctgaagcaataaaatgtattgattcactgtggagaagaagaaagttacgggagaccatttataaatgatgagcaaaattcttaatacatttaaagttttatcacctcaaacattttccaaacaataggatatgagtagttgtctctgaatccatacagttttcaaatcagaggaatgacaacatgagatttaatataacatagaaaaacagggacagatttaaaactcatcaggtgtttgtttatttgttttttgggttcgtttagagacagggtctggctccgtcacccaggccggagtgcagtggcgtgatcatagatcactgtaatcttgagttcctggactcaagtgattcttccaccctagtctcccaagtaggtgggactaaaggtgtgtgccaccatgccttgctatttttttgttttttaagagacagatcttcctatgttgtggaggccagtctcaaactcctgccttcaagcaatcctcctgtcttggcctctcaattgatgataagttttctaatcagatttagtgcttttctggaaaaatcattagacaacaattctgaagctaaatattaagtgtgtgcctaaaaatttagcaaacttaatggaagaggtcctcagaactcttttaagatcaaacagttcaatactaaaagtaaaaatttgaatggaaaaagagggtgtggggaaaccaaattacctatcctgtatgcatattggaggtggaatgaacagaccaggggcatcatgcaaaattctcaggcgccaagtagagtgaataagtgtgtggtaattattcacagtgtcaatgcatacaactgaaaataggatcagtacttaaatgctggatataatatattatcaggtcaagactcatgacctgataaagaccatctgtatgtccttaaatgtccttaaatgctagatgtaagcttggatatttgtttatgtttatgtgaatgacattccttctttcttcctgggtttttgtccctcttttattttgttctgtttatggagatgaagttctgcattagataggatcagtgaaatataaacatagatttgtgagcgtataaatgagactacccaaaacatttcccctcaaattaagactttatattttgagacacactggaatcagtgacgtcagtttggaagctcagattttcctagcaacaaatagtgtggcttagacagaacgtcagtttcaacagtgaaattcattgataggttctttgaatttaactcagtggctcaagttcagtttggagtaatgccggaggcatgtctttgccctaagaatagtctatttcctcacacctgaaacatattcttatctcctttcctttttttctccagactgttcaaaatctgtcctttagctgcaagtctaaacaacaaccaattctagaatatagttttctctaaacgttcattctgttgaaatattttagcgagttaacacttaaaataaaacttgctctgaggctttgaaaagtgaaagtggacgtctgtacagataaagtatcaagtttattactatcatgtaaaattttacagtcagtgattatttcctttggaataagatttatgtacttcacctctgaggcaagacctcatattcagctgtatttcaaattctgtttttcacatagatgcacatttcaatatgttaatatgtaatttaggaaacaatttggttgtctctaataggattataaaattctctctttcatgtacacaatgcaggttgagaattttctcagtggacatgaatttttttaaatcattaccagaaaagtctcaagtactttatgcctgtcttctaaatcaattcttaataattttccaagtgaaaatccattatgattagcttgacatctcatacaaacaactgtgtcaaaatttttttctcccagtttacccccactgatgtagttcagttatatgaactgctgtttatattagatttgagaagggttctgacttgtgttctaaccataccaaaaagaaaattagaactttttataattatgactttatggtttagttccagtttgtttatttcttattttttatttttataacttcaccttttattttagattcagagggtacctatgcaggcttattacctgggtatattgtgtgatgctgaggtttggggtcctactgatcccatcacctaggtactgagcacagtaccagtagtttttcaattctcaatcccctccctctctcctcgctttagtagtccgcagtgtctgttgttaccatccttatgtccacgttcccatctttatgtccatgtttagttcctacttatcagtgagaacctgcgatatttggttttctgttgctgcattaatttgcttaggataatggcttctagttgcatccatgttgctgaaaaggacacgctttcattccttattatgactgtatagtattccattgtgtatatgtaccatatttgttttatccaacccaccattaatgggcacctcggctgattccatgtctgtgctattgtgagtagctgcaatgaacatacaagtgcgtgtgtctttttggtaaaataatttattttattttggatatgtacccagtaatgagattgctgggttgaatggtatttgtaaattctttgagaaatatccaaactgctttccacatagctgaaaaaaattacattcccaccaacagcgtataactgttctcttttctccacaggctcaccgacattggttgttttttgaccttttctctcttttttcttttttttttttttttttttttttgagatggagtttcagtcttgttgcccaggatggagcgcaatggtgcaatctcagctcactgcaatctccgcctcctgggttcaagtgattcccctgcctcagcctccttagctgggattacaggcatgcaccatcacgcccagctaattttgtatttttagtagagacatggtttcaccatgttggccaggctggtttcaaactcctgacctcaggtgatccacctgacttggcctcccaaagtgctgggattacaggtgtgagccataatgcccggccatttttttaaccttttcatagtagccatcctgactggtgtgaggtggtgtatcattgtgggtttgatttgcatctttctgagtgatgttgagcatttttcatatgtttgttgaccaattgtatgtcttcttttgagaagcatctgttcatgtattttgcccatattttagtgggcaaaatatttagttcaattgcttaagttcatttcttttgagaagcatctgttcatgtattttgcccatattttagtgggcaaaatatttagttcaattgcttaagttccctatagattctggatattagaactttgtcagatgcatagtttgtaaatatttcctcccattctataggttgtatgtttactctgttgatagtttcttttgcagtgaagaagctctttagtttaattaggtctcacttgtctatttttgtttttctcacaattgcttttgaggactcagtcataaattctttgccaaagctgatatccagaatggtatttcctaggttttcttctaagacttttatagttttaggtattatatttaagcttttaatccatctcgagttaatttttctatatggtaaaaggtaggggtccagttttattcttctgcatattgacagccagttatcccaacaccatttattgagtagggagtccttttccgattgcttgttttgtctactttgtcaaagatcagatggctgttatgcagctttatttctggattctctgtcctgtcctattggtctatgtgtctgtttttgtaccagtatcatgccattttgattactgtagccttagagtatagtttgaagtcaagtcatgtgatgccaccagctttgttatttctgcttaggattgctttgtctatttgggctcttttttggttctctctatattttagaatagttttttctagttctgtgaaaaaataatgttggtagcttgatataggaatggtgttgaatctgtagattgctttgaacggtatagtcattttaacaatattgattccatgagcaaggaatgtttttccatttgtgtcatctctgatttcttttggcagagttttgtagttctccttgtaaagatcattcacttcttggttagatgtattcctaggtattttatttatttatttatttccagctactgtaaatgggattgtattattgattttgttctcagcttgattgttattgatgtatagaagtgctactgatttttttacattgattttgtggcctgaaactttattgaaattgtttatcagtttcagggcccttttgaaagattatttagggtgttctggatatagaagtgtatcatcagttaagagagataatttaacttcttcttttcctgtctgaatgatttttatttatttctcttgcctgattgctctgtctaggactttcagtaatatgttcaacagcagtggttaaagtgggcatccttgtattgttcctaccttagaaaaaaggctttcaatttttcgctgttcaatttgatgtaagctgtgggtttgtcatctatggcctttatgttattggggtgtatttcttctataaccaatttgttgagaatatttattatgaaggtatgttgaattttattaagtgccttttcagcacgtattgaaattatcataaggtttttgtcctagattgtgttcatgtgattatgacatttactgatttgtgtatgttgatggctcaagcatgttggatgcaacatcctttcatccctgggataaatgctacttgatcatggtgaataatctttttaatgtgttgtttgaattgagtttctagtattttgttaaggattttagcaactgtgttcatcagggatattgcccagtagttttctttttctgttgctatgtccttgtctgctattggtatcagggtaatgctggcctcatggaatgagtttgaaagtattccctcctcttaaatatttgaaatagtttgagtagaattggtattagttcttctttaagtgtttggtagaatttattagtgaatccatcacgtctttggattttctttaatgggaggctttttattattgcttcaatcttcttactgtttcttcatagttcaaccctggtagatcatgtgcatccaggaatttattaatttcttctaggtttttcaacttgttgcatatagctgtttatatagtctgtaattatcctttgtatttctgtggtatcagttgtaatattcccttttcagtttgtgtttttatttatttgggtcttcttttttcttagtctggctaaaagtttgccaattttgtttatctttaaaaaaaccacagcatttagttttgttgatcttttatatttgttttattctcaattttatttatttctattctgatctttattctatccttccttctactaattttgagtttggtttgttcttgcttttctagttccttgaggtgcatcattaggttttttgtttgaaatctttctactttctacttttttgatgtaggcatttattgccataaactttcctcttgcactgattttgctgtatcccataggttcaggtgtgctatgttttaattttcatttgattcaagaaatttttaaatttccttcttacattcttcattgactcactggttgttcaggagcatgttgcttaatttccatgtatttgtacagtttccaaagttccttttgtaactcatttctagttttattcccttatgatcagaaaagatacttgatatgactgcaacattttaaaagttgttgagaattgtttgtggcctaacatatggtctatcctggcaaatgttctaagtgctgatgagaaatatgtgtatgctaaagtagttgaatgaaatattctgtaagtgtctgttaggtccatttggtagactatagtttaactttgatatttctttgttgattttctgtgtagacaatttataggttcctttcgatcttggactgttactaaaaagatgcactgagtataattatacataatttacttcatacttattcaaatacttttggagattaaatttccagaaatgaatttcgtaggtcaatggtgtttatctttataactttggtagctattgctcatttattttcacagaggtgcatcacattatactctcaaagtaatacatgggagttagcccttacccacagtcacaccaatagagtacataatcagacttttgtatttttgtcaatctgagaggtgaacaatggtatcgcaatgtagttttaatttgtatttatattattagtaactggagagattttctttttaacttttaagaactacttgtttttcttttctgtaaaaggtctattcgtatcctttggccatttttcttagatttttatttttgccttattgatctatatgtactcttgtactagaaagattaaccctttttaatatgagctgcagaggatttttaaaaaatatattgttgtttgataggactttctcttctgattcattggtctatagagttgatcctgagtttctctagctttattaatataatgagttatatattgttttttagagatttcttaatattatttgttttcccaaatgacattagaatcagcttttcttcttcccaaataaaaatctatttttactggtgtgttaggcttttctcacattgctataaagaaatacctggtactgggtgatttacaaagaaaagaggttcaattggctcgtggttctgcaggttgtacaggaagcatggtgctggaatctgcttggcttttgtagaagtgtcgggaaacttacaatcatggcaggaggcaaatggggggcaggcacctcacgtggcaggagcaagagagagcaaggaatgagatgctacacgcttttaaacgaccagaaatcacaagaactcacacactattgcaaggacagtaccaagagggatggtgctaaactattcatgagaaatccatccccatggtccaatcaacttccaccaggccccaccttcgacattgggaattacatttcaatatgagatttgggcagggacacaatccacattatatcaactgagatcatattaaatttgtgcatcaatttaaggataattgacattttcttaatattgaatattgttcaagtatttttattgttcaggaatgcaggtcttgaacacttttttggtaatatatctgtttgttgcaatttagatttcagatatttatttcttatattaattttccaccagactaccatactaaagtatctgaatatttatatcaaataaaaaaattatgtaacttgaaagtacagtagtaataatttacatcttctttcctatttttatatctgccaaatcttggtattaacgaaaattacttcggtgttgctaaatcagagtttgactttcaggctgaggttgctgtatttcattacattaagtatctttctactattgttttctttagattttttaaaacttaagaataagaatgtcgtaaatgtctttacagggtttaaggagataatcttatttttcctttagctttattaataaaatgaattgtatattcataaatttgctagtatagacccatttttgctctatgtgaaccctactgttcataatgtgttgtttaatatgctgttagaatctgtttgcagtattttatgatgtttgtattaatatttttaagactgaatatgtatgcaatcctaacctagtttaatattaatattataatagcatcacaaaaaatgataatatctcccatacctcttttttgatttggtttttgttttctatgcactgagctagtttaaatagcattggaattatctactaaaaagtattgatagaatttccccatgagattaccttcttttgtgagttttagatgtttaagtcttttctctatttctcctattaaaatctattagtttccattttgttccttgctgggattaggatgaataagtaatattctcccaaaaaattattcaattaatctagatttgtcaatttaagcaatgtctcttttatgatgtgcttatttttccctattttgtgaatatccttctgcatatgtttttcttttcatagctttaccttcttatgttttcttgatcaattggtattcctctccctcaccacaacaaacttgacttatgtatcagtgtaactgtcattttatgttttctaactattaatttcagcttttttctttgttaattgcataccgctgctttattttagatttgtttcatgtacttttataacactttttagtcttattattgatttatttgttttctttctaattttaaaattgatctacagtttaaagctatgaattgttctctctgcactgttttggcaatttcccaaaagtcttgatctggagcttttaaaaatcattcttataaaggaaattttaccaattcagtatgtatttctctttatcctaaaagtaatttcagatcaatttactttaaacttgccaggtaattgagtcttttcattttctgagttttttattgattgttagtcttattggattatactcagataccatggtcagcaatatatactttttggagatattaaagattttgtatagttatagtcaacattttatgagcatttcttttgaaagctataatctttatttcaagtcacagcgttaaacatttatgttagatttaccatcttaattgatatatttgtccccttgatctgtcatggacttaggttaataaaacttctgccacaggatatttctctctccttatagtctctgtaatgtttgctttatgagtgttggtgtggtattgtgttatgaacagcaattcataactgttttatctttactgtgaatttttcaaattattgacaaaactatcaagtgataacagattaggtagaaggaagaggaaagctgctaaatctataattgttcaaggaagagaactaatagaataaagaaaaagaaaaatttaaaaccttaaatatcaaaataagtactaaataaaaaataagtaaattactcaaaaaaaaagcaaatcatctcatgttgaaagactttttaaaaaagctttagaaatagaaaatatgacattaaatgacattgaattaagaccagacatatttgtcaaagtaataaatatcaataggtttaattcacatattgaaagataaagtcatcagattgtactacgaagcaaagacactcaattaaaataaataactcagaaaaaaattgaataaaaggatgagcaaaagtataaatagaaaatgtaaaataaagcaagatgcaatctttatatatgacaaaatggaattcagaccaaaaaaaaatgatgagggatacttttgtcaataattttaactttcttgatattcactttgtattcttagatttgattatacttgttttacctgatctatcatgtttaaattatggatagtgagtaaaactatgttaactcctctatttgtttagttgtttatttttacactttcacatatcatttcctatttactgttaccttaatctccacatttgttcagtctcagtcctataattaaatatattcgatagtcacaatatgtcattttgttatagtttcaccagtcatctcttggctgacttaagttctttttccagtaatgaagaattcatgggaaaaatattagctgaacacttgcttgatcaataccagtaaaacttatacaatttgacttggtcaaacatagcattcatgtatcatgtttttttttctctgagtattgtacaggtatttctatattagtctctgtcattgaatggttgcatttgatacatttgaagccaatctgacatttctttctttattctgacttaaccttttttgagtggaacttcagttttttctctatccttaaaatccaataattttaataggcagtaaccaaaattgaccattctgagttaatcgctcccaactaactcagaggatgttgcattttttcaatgtagattcaaatcatttttatttcctcaaagttgtcttgaattataactttaaaaaatattcttctcaggcttttcttctttggaaactcattttgattatgatagaacttatttatctgcttactaaatttgtcattttctctctaaactattttaaatatatctttttgtttattttttctcacaactatcttttgtcccttgctagtttttccatagtatcctgcctttcttgaagtttttcaaatcttttttcctttcttttatgtgttttgtttttcttttctagttctttcctgatttctgcatgctcattttcatccctcctattgttaagatatgttaatcctattcctacatttttacttggctttttccaaacgcatggaatattatttcattaagcttctgttgttttctttatgtattcattttcattacatttctcatccactttcaggcaatcttttcctcgtgcatatttttcatctgcttgtagatttctcccatttttcatggaaaatctttgtgttggtgctatacccagttcttttttcattgttcgtcactgaatgtgttgaattttcctagattagcaatttgggggaggtacctaagcaggaggctaggggagaaaggatacagtagcccttcagatttttcatttgctcactacttccatcccttaggggtcctgttgattctttctatggatgtgcctcctttttctgcaggatacataatgtaaccactgctctgaaaatggccctgctctcttgtattctatacccttaattgtatcaagggtgtagcttttggaattcaaattgggcaccttgtttttactttagataattttttttttaaactggaacttcagtagatattccatcgcttgagcttttaccattctgctctgacttttttcagttcctcctatgcagattccacccaatatcatcaatataggcagaagaaccattggggacaaaaagagaggattattaagtttctcataatgaattacttgaaacgagagaatatatattagaaataaggtttcaaaggtatgcctgggttggtacactatgaattttaataagttagaactgtatgatatttttaagtgatggattttaaaaaattaatcatttgcataattaatcagactctgctaattaattctataaaactatatgcaaaatgcataaaatatttttgaaattaaaatttggactaataaagaggagttaaaatgataattagaaactttctttgatgcaacaacaatatgtgctctttaagaaaaatctggaaaacataggaataaagcataaattaaaatatttaacattttggccatagttaaatataaatgcatacatgttattgttttaaaactagaatcacactcaaaatattgtgatctctattttaatctttttgtatatatattcttttaaataggatttttataatggctgcagagtatctcttcatatgcaaaggtgtaatttgtttttatcagttctccattataagatattcagatggtttcgacactgaaaattgtattgtgttaattgtcctaatgaagcaggatatttccctgaccccttcgcggaattcctgacaggggtgcctcatttactcagccccgctcgctgctctcagctcctcgcgggagggagtgcacgagcgaacgagtacgggagctggaatgaatgagtgctggaatcggctggccacttggcgctggtaggacccaaccccactcactcggacctgcagcgttccacccctcatgggagggagcgcacaggtgagcaggtgtaggaactgaccccacactttagaaccggcaggattgaactccatgcaggccccacagcagactccaaccgggggtgcctgcgactctcagagccccagagggcacgttacagtgctcttttagctctgctgtccgcagtccgcagtccgcagtccgcattagtgttaatagctcagtggggcctctgacttttcacatgaggcggctgccttccaccagccagggtgaagagccagtgtgacagccagactcttctcgaagttacgaagttacgccaccaagctgtccctctgaagtcaagccacttctctccgatgcccagctgtatcctgtctactggctgagtctgggattaatataggcacaggatggggcggggtggggccatgagtggtttaggaaaaagcaacatttgagcgggaaaacagggatagaagttctcactttgggctgtggtttcaggcttttcagcttgagggtaggaattcctggggacctactcttttctgcctagattttctgtgcctgctgttccctatcactaatacacaaatcttggtgtacttcaaatagtgtaatccaaatagtgtaatccaatttagataaattggaaggagtaaaatttctgggacagaaaacaatgcatatttcccatatatcttcttaaattgtcctctagaaagattttattacttatttattatcattattcaacagtggttgatttccttttctttgaatctttaatgaaaatatgcataattttaagtcattttgtatatttgatatataaaatatggtctcatctttacattatagtgtgaaacattagtgagattgaggtgtttttgtttgttttgtttgcttctcctgaattcatggggcacagacatttctcctttataaactgcctgtccctgctctgtagctgggttgctcttggtacattgtcctttttctatgtaaaaactcttagtgaaaactctttcatatgggacaaatatcacttctcttccccatctctggtttgccttgcaattttgtctgtctttttaatacagaattttaaatgtttataaatctgttggtatgttcctttgaattttcttctgttttatacttagaaatttctgttttgaaaatcatgagtatgtaaatataattttttcatttttgcattttggaaatgtcataattaagaggtgataattgtgacatgatctgaggactgtttctgtatttaccgtcatatctcatttgtctcactgatgtttctttactagaattagtctcatttatgtactgcattttataatatgcaatattatcatataaagcatataagatactattacaagataatatagcatattcctcactatacttttctattctatataaattttaaaacattttgtcatctcccaaaaaatagtgtcttggaatttttatttggacatcactaaaactaaaatatttagggataattgatcagaagcaacatgatatttctctttctaaattttttatatttttctctaaattgttttatagtctttttcatgtaatatatacacacacgtatgtgattttccctatatattttgtattttatgtctggcttattttacattcttttttttttttttttttttgagatggagtctcactctgtcacccaggttggagtgcagtggctccatctcggctcactgcaacctccccctctgggttcaagcgattctcctgcctcagcctcctggtagctgggactacaggtgtatgccaccacgcccgtctaatttttgtatttttagtagagacggtgtttcaccatgttggtcaggctggtctcaaactcctgacctcatgatccacccgccttggcctcccaaagtgctgggattacaggtgtgagccacagtgcctggccaacattcttattaacaatatgaggccaggcgtggtggctcaggcctgtaatcccagcactttgggaggctgaggcgggctgatcacctgaggtcgggagttcaagaccagcctgaccaacatggtgaaaccccgtctctactaaaaatacaaaaaagttagccgggcgtggtggcacatgcctgcaaccccagctacttgagaggctgaagcaggagaattacttgaacccggaaggcggaggttgtggtgagccaagattgctccattgcactccagcctgggcaacaagagcaaaactctgtctcaaacaaaacaaaacaaaacaaaacaaaacaaaaacaatatgaaagcaaccaatttcctttaaaagtatttttaaaactttcaacaattgtatgggctttttgggtacatttctctttagagattctattgtgaaaatattgtattaattgtttgacctttttgagcttttagcttaattttaaaataaaaactgcttaatatttttgttcattttatattaaataaaaaccggtcattaactataactcttaagttgacatttcacacaaaaataataatagagatggatagatttttatcctcattcttttaattataaatattaattaccatatgataccagatagtattttatctgctgaagtatttgatgacttatattacaaatggctttataatgcaggccccagatttctaaattagtagtgtttatttttatagatcaaaatatcatgtccagtcacagtggctcatacctgtaatcccagcagtttgggaagccaaggctgatgaatcacttgagctcaggaactcaagaccagcctggccaacatggtgaaaccctatctctactaaaaagacaaaaactagccgggcatggtggtgcatgcttgtagtctcagctacttgagaggctaaggcacaagaatcgcttgaacccaagaggcagaggtggcagtgagctgagatcacgccactgcactccagcctaggcagcagagcaagactccatccaaaaaaacccccaaaaacctaatgtttttatttatattttagattagtgggatggtttggccatgaactcagcaccagatttaagatggataacagtaagtgtatttattttacctaatgccatttttattttaactttatttcaatgttcatctgtctttgtattatgtgtaatgtatatgccccagggagagtgcacttcaaaaatgtcactgagaattctcaaataagaaatgacatttccagagtgtaagactaagagtttatagattttagcatgattttgagtctatcccttagcagggagataaaagaaaatgaagtccaaggtaagggtcatgtggcttggtcaggtgccatcaacatagagtgcctgaaacactgggcatggaggacaggaggaaatttggggcttggagtcagatccagaaagacctgggtgttaatcacactttgctgcttaatagttttttgatcctgcacaagttatatcatcttgtgtcattgttttttctttcccacttatctaatgtgaataataaaatctatttaaagatttggttttagggttagtcaagctcaaaacaataagccaagtaggacacagcagtaccttaataaatactcattttcactcctcttttttcctattttccttttgtggcttttgccatgtaccaaagagtgtagcaattcctgtgagcagttaaccccagcagatagaagtgaaactctaccatgcagagcttccttttcctgcatgacctcatttctcaatcacatgggatgcagaaagatcatacgtgctttgagagttcaacataaacttgatccttcagattgctttaaaccctgagatactgttttaaatttgttttcattttttattgactttatttttttgtttttgaaacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgctgattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatatgatttattgaatactatactaaaagtggaaaacacaatgggcgtatgggtagtcgaagtatggcttctacttaagatgtactgcttttgtatcactgtaaaattgaacaattttaagtcaaaccattgttaagtcagggaccattggtatgcagatttgtagcaaccaaattgcaaaatgggatattccagtcaagtcaggatacctgtattttaccttggctgctaaaataattagatctgttattataccagttatttaaattctttgagatgggttttcttatttggaaataaaggaattgaatttgatcaggggtagcaaactttttctgtgaaaggccagataggaaatattttaagctttctaggctatacagtctctgtggcaaatactcaattccgtcattgtggtggtaaagcagccataggtgatacataagtgaaagattgtggctatgttttcataaaactgtattttaaaaagcagggcctggcacgaagactcacgcctgtaatcccagcactttgggaggcaaggcagatggatcaattgatcacaggagtttgagaccagcctgggtgacatagtgagaccttgtctctataaaaactacagaaattagccaggagtggtggtatgcatctgtagtcccagctacttgggagcctgaggcgggaagatcacctgagcccggggaggtcaaggctgcagtgagccatgattgagccactgcactcaggcctgggtaacagagtgatactctgtctcaaaaacaaaaacaaaactagtgggtcaaatttggcccacaggccatatggccatatattagtctgttttcacactgctataaagataccacctgagactcagtaatttgaaaaggaaagaattttaattgactcacagtttcacatggctggggaagtctcaggaaacttacaatcatgtcagaaggcaaagggaaagcaaggcacatatgaggtgatgggaggtgagagagagagagaaagagagagagtgcataaaaactgctgtttttggccgggcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagatcgcgccactgcattccagcctgggcaacagagcgagactccatctcaaaaacaaaaacaaaaaaaaaaaacaaaacaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatcttaaccctattgaatttaacttgctacagttcaatctgcttaattctaattagtagagcatctgttattaatttaccttttttatatacttaggcagatcttttttttaaagctccctctattgtgtgtgtgtgtgtgtgtgtgtgtgtgtgtctgtgtgtgttctgtaagagaaaccacttgacctaacaatcctagagctaaaagtcagcttcataggtcatttcattcatatttctgcctttgggagacattacaattacatgccactaaaagctgatgctctctctcattgacatggtttcataatagaatagcaaatgttgagcagaataaggaatcctggcttgggaataggaaggcagagaatgagatccagaaaaacttccagaagaggtcatttttaccttgggtctaagatttctggtgttctgctaagaagttggggacaagggaggtgggaactgctggtaaacgggaaataacgtcgatattttagttccatggagcttatcttaaatatctcagaaatcctacttaggaagaaaagtttaagtcttgctcttttactctccagtactctagtatctttatggacacttttaaagttaccttctatgataatgacatgatattaatttctcagaactgcagttaatccctggggtctgtggattccgaatttcaaatcctcccattttgttggtctgttccttgcatgctagtttagaggtaagtgatgtgtgtttcaaccttcccacatctttgcgttttttcttgatctgtttgtgacaattcatagtactttctctgctacacagcaagatgatacatgtgcactgtgcatgaacaagggacagaaggcagcattcccctttaggacagtgatgatgtggtgagggtctcccttcattcatgtcaccagcccccagcacaatgcttggcacattgttggcacatagtaaatattaaatggaactcttttggggagatacgttttttactccacttagaatctgtttaaacatgaataagttatttaaccttctcttggcctctctttataccaaataagcatgcaatatttagttcttcataaattcgctcattcaacataaatttattgagaaaatattgtgtgcctgatgtgattactagggactgtactttttctagttcattgtaggtgaatgaactgaccaagtaccatgtgacaaagctaggaaagacttacttgaaggaaaaaagaataatcagagtaaaccaaagattaaataaggttgtctcataaggtagggtggttttatgatttttttaaattgggacttctatgccattatgtccatttatagtctccactatcactgactcaatattttcctttaaattaatttatatttttatttaggtaaatttagtctcaccctgaaatgataaatatacataacaagaaaatgaaattgtgattccttagatactattatttagtgttagactaaatgtggccaagtaaaaatatataggttatatagtataaaattcatatataatgtaaatgtataaatatttacataaataatgtaaatatataaagtaattgtatattttgtatacctatatttaagtaaaatatattttaagtaaatgtgcatatatatttctaatagaagttttacatagaactattcaaacaaggatttgaaattttttcatgtctccttctaaaatcatgtagtttatgatattttggcaaaaacttatagaggatttcagcatcaaatgagtgacaggatgaagattcaaaattccttctaatctaaaattgcataattctgtgaacacttacagcagtttctcattctggccactggatggcagcatcaagttcctctgtttttattaaatttcaccactggatagtgatcatcacctcatttcattctgtctcaatttaaagcgcacctactcagtttaaccactagatggagcttgtgttgttttcacttcatggcagaatttttctttaacttggaaaatagacacagtaacgagatttttcagccagtgatatatatttttgacagttttttgagtaaaaatctgcttagtaaatcagataatgatatttgagttgtttttatagtatccattcagataaatattttgtttaaacattttaaaacaaaataaagtttctgcattccttgcaagtttgtatcagcgagatgtgtgacaatatcagaagcaccaggacataccttaggaagagcttgtacctaaagtaatttcctctggtgcccatatctttgcaaataacttctcagacgtacctggaaatttccttttagacgccttcactttggcatactttctgcagtggactggcttttctagtagtattcacccttctcttgtgggaaaggaagcacattcctattcttccagccactgttttcctaccacactgtattagagtcacctagacaaagtttttattttcagttataatctgagaactgatttattttttctttttaatatctaaacttaaacctcagcctcctgagtagctgggactacaggtgtgcaccgctacaccaggctaatttttgtagttttttgtacagataaagtcttactatgttacccagtcaatatctaaacttaaaaccctaaaagccacaagaagaatgatatgcatttctctggatcttctaatcacttacatatttcccttgagcctctttctgctcatttcactgctgagactatgttctaaccaaaattatctttagttaatcaagccttatgttggtaaaagtgttttttcaaaattctttcctactgtaaattgcaaaatttttgaattacaaactaatgcattgaattgcttccctttctctgttaaaatgtcttattttctagacatttatgggtttctcatgtgagtaaacatcagtgaattaactatgcttctattaatacttaccttcctttaagttttatttatttatatttagagatgaggtcttgctctgttgttcagactggaatgcaatagtacgatcatggcttagcatggcctcaaactcctggggttcaagtgatcctcctgcccccaccttccaggtaactgggactgcaggactgcaccaccacacttggctgattattattatttatttattttatttctttatttttgagacagggtccccttctgtcactcctagagtgcagtgatgggatctcagctcactgcaacctctgcctcctggactcagttgatcttcccacctcagcctccacagcagctgggactacaagagtgcaccaccatgcccgactaatttttgtatttttttatagagacaggattttgccatgttgcccaggctgatcttgaactactggctgcaagtggtcctcctgagtagctaagactacagggcatgccactgtgctcagcttatttttaaatttttttagagatgaggtctggctatgttgtccacgttaatctggaactcctggcctcaagcgattctcctgcctcagtctcctgtttgaaatgtttgtttttcagtgctataaagaaatagcacttgaacgcaaatttaatttatttagtaaggccatttttacttcctgcagagaggatacactcgccagcagttttgccatgagagtacaccgaacaaaggagacagggtcatttataacctgacgtgtccaccctactgctgtgtccagttccaatggctggaatgggacctcccattctgtatttgtcccgattggctagtaacttagaactttttaaaagacgtaaaggtagagggtaacaaaggaaggaggaagtaacttgtggaatgctaagaaaggtaaaaacacttttaaataaggaagaggaacaggctgtgacctaatgctgcttggaccagtataagcatgccagggcaaatatttaggctaaattgtgggagctaaaaacataaagtatattgatttatttattacagctagcagatatttaagaatgttagcacaggtctttgaataaattttgcttctaagagaagttactatttattcctaattagacgggaaggaaagtctttgaagaggaacctctactttactttttatactcctaagcagttgggatgacagacgtgaaccactgcactcagccaccttatctttttaaaccagtttattccattttaggagataggtggttgaagtttcaataaacgaaagaagtaaatgcatgaatcaaactgcctctttgttgtctctacttttaagaaatattcaacacagtcaaatacgaactggaggagagattctatacttaagaatcaatcacatataaataagaccttagatttttaatgcaatgactttttaaaaagatattaatatggctttttttaataaatacatgtgtatatggttgattgatataaaaaatagcacattgtaatcagtttcaaactgtccttttgtttatatttttttatctgaatcatttatacaatagttcttaaaatattgtggatcaagggatgaagcctgaggccaggaacctggtggcaagtactctctccctcaatggacacgaagtgtgaccttacacaagcaacaactccctttggatgtatttgccttattttttaaagtaagatgtttggacaagattattttggaagtctcctcactttccaaaatacttaaatttaaacaatacgtatattatattttgagggttcatatttatgtgtagcgataggtagacaatatttagtccctttcagtattctgaattcataatgaaataaatggcttcaaaatacaaagttagagcattcaattaaaatacatggcgagtcagaagactcaacaaagaaatgtactatacgtttcctttcaaatttcctagagagacagttttaagaatttaagagaaaaatatgacaattgaaaacatcacaccaaacttatttttcctgtttaaacttatctagcttttcaagctttgtgttcattttgtcagtaagaaaaaaaatacaagtagttgaaactctgcaaagtattatcttctaagctgaatatttttcaaaccacagttttcattttttctaatttaaaaaaattattttctcaatattgaaagcataacatttatgagaagcaaaaaagaaaatagaatatttatgttacttccctattattctctctcaatatttttatgtgaagctcagaatagacttttaccctctgtgagatgaatttaaaagtgcctcagaatgcagttgcccttattgtggttgtaatggagaaagtaagttttatatttaaaagttattttatgatttaaagagtgttaacattccacagtatattaagatggaagctatttgtcataccaaaaaaattggtttctagttatcaagagaaagcttcaagagcaacattccctacgcccctttaaaaactaaatgcaagtaatattcctccaagttttactaacctatgcacacaaatgaactatcattaaatgtgatacttcacatatcgattgcccccatgtacatattagggcacccatagcataaccacaaaatttcctagaattatttattatttagaatttcttagaatattattaagctccagagagaatcttggaaagattcctcacatagtctttttattccaaacttcacagccaaaccagctgtggcccgtgccttgcctgtccctgctcctctgggagaattttgattcttgtcccttgacccaaaacttggcagtgttcccttgagtcttcattatgccaagtctacctacatttgctttgcccaagaaaatgaaggagatgcctcctaccaagttctgtgtaacctgggtcatctgaatcttggagcactattatttgtactgcagatctctctcgggagcttatgaagccaagatatcagcctctacttgagctgtctctgtagacttcagacattgtctgggagttgtggttgaagagagagacaggcaccattctgtcctgtttttcctctcttgcttagatatcatttaccttcagtacagttcccagcctctccttcagccaatccatagcctctatacagtatagttccaggaaatctatggctgaatggtttgagttttattagagtgcctgcctacacatgccacgtgtacatacaggaataactgttttcatagacttgataaagtctcaatatcaccaaatgaccctatctttgctcttgatatctttgctcatgacacagaaaaggaacattaagtggcaggccagtgcatcacgctctgtttgcagttcatttagttcttatacataggatatatttttacactctacttgaccttaagagataagccagaaaagcacatctgttctgacccctaatattccaacaccagttattgtgtgcccttgtcactcatcttaatataagacatctcagcccacaaatggcagtattttcacaccagtgctagagtttagaaggggggaaatgagagaaaccaagcccaaatgcttcagtaaaaataaatgcattatctaatattatttgctttcctctctgaggaaacttagcattattatttaactgcttgttttcttattgttaaactggaagagatttgggagtcagtaaagcagttataaatatcaccagtaacactgctttacacatttgcacatgtttagatcatattgcacttttttgaggataaacaaactttacatcaaagttggaaaagtcttcttgattatgatttcaaaaagtggttttggggaaaagcttacattgtatgatatttaaatccatttattaaggtatgttttacttgattatactaacttaatttaaaataattttgaaggtatgttcccggaccaaattgagggttgggctgctatttctcatggcccaataacaagatgcagatgaacaggggaggaagagagtttttatttctgtaactggttacagggagaaggcctggaaattatcaccagaccaactcaaaattacaaagttttacaggtgtaagtgtgcattcatctgaagacataagtgattaacttcttttaatctacaactaaggtctgagtcctgaagaccttcctctggagcctcagtaaatttacttaatctaaatgggtccaggtgctggagtgattacccttatcttgtcttctgctaaatcactgaagtttgaggagttcctttagaccttcaataaacttgtttgtagaggcctggagagtttcttcacaaccacagtaaaacttgtttaatcctgaatgggtcctgttaagaattccttcattattctgtcatgctttaaggcccagggaaagcctaggcaaaactcttgataggcttttgttcatcccagcctttgtataagggcactgacttttttagtttttaatatttaatgtaaccactcggtcagtactgaaacagttgtgatggaggcctgcattagtgaaacctggcctgccacaggtacatgatattaacttacattttcttcctttgcaagttttatttaagtgacatttgtacaatttttctgtcatggaaattttaccttcagtatttaatagcaaagcatttaaaggagggcatgattttacacaaaaagattatgtaaagggagatatttattggaaagatcaaatatgggcatttcctttttatgcatgatttactcttaatttttgcttctttgtaaatcaataagacactttaatctgattgtttctcattccacagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggttgtaagtatgtcttgctttgctaccagattttgtctatgggccgcatgttagggataaaatttggactctttggtttattcattgttgcatgttatttcacatcagtcagtcaattaaggataaattaagtgccaactaagccctcagcactgtgctaactgaaaggcatagagatctgtcgtttctgataaaagagaagataccacaaacttggcttataggaatagttttttgtaacttactcattcttttcataacagtttgggcagaaaaaagttattatttcatcatactcagtcaggacattgttttctctagtctgtactacaattcatttattggatgaatggaattaaagatcataccaatttattgaagggttaaaaaagaaagtcttatttagtcgcttgatcaaattaagttattttcaaccttgtcacttctgtcaaaaaagatatatatacacttctcaggagtggtaacattgcaaggaataatttttttttaacccttcagcctatatgaccttcttggtctcttgaagagaactaataaatgtgaactgagtaatttcagggaaaaaagataatgtatctacttccaatgattatgtaattaaggcattgcttggctcatgtttacctgtaggagaggttactcccagatgctggagacacaagtcagaaattcaagtttctaaatcaaactctgctgtcgtcaaactctgtcctctttggaaagttcattaggatctattggcttgaaattttcatccgtatttggggtataaaataaattacctccaagagttgtgattggattgaaatgggacagcacacataaactatatactatattgtctagcctatagcaggtgttttctaaagttaaccatagtgatctctaggcatgtcaaattatctggtgctacttcaggacctacaatgtagcccacttcttatttgtgagatcaaagattagagaattaagttcaaggataatttactaaaactctccagaccctaatgaggttttcattcacttaaattcacccaagaattccagtccttccatggggtccccacgggaaaaaaaaaacaaaatgtatttatggtctattaaatgcttaaggaagatagttgctgaatagatttcaggaatctatcttggctatttatgcaccaatccattcttatttcttaaattattatcaagagaaaagtttcataaaacagaaaaacaccatgttttaaagtaaaaaaattttgcatatatattaatttttagggaaatcattatgaaagtgctttacataagtttatctggaatgtagattttcaacgtgtgaataatgctaacattattgtggctttattttttccccacagtgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacagaaaatctga

SEQ ID NO: 2524 - DNA, 164692 bp, Homo sapiens; identical to SEQ ID NO: 2523

SEQ ID NO: 2525 - DNA, 111913 bp, Homo sapiens
agcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacgggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatcaaagtaaaaaacatgcaatggtgaaccttggtatctttgtctaggaatataaagaatggcttatcagtggagaccatcgacagttgagaaaagaagaagcccaaaaagtacaagaatgaaaatcgagagtgtaagaagaatgtctgttttactggcattatctaacactcagatatgcaactctttattgccaaacactgtgtgtgttagttaaggtaaaaggtgaagggaggcagaagaatggagattgaattgaattctagagctttagttctgtgtgagtttgggcccccagaagttctagacattaagtacagtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgcacaacgtgtaggtttgttatatatgtatatatgtgccatgtcagtttgctgcacccattaactcgtcatttacattacatatttctcctactgctattcctcccccatccccccactccacgacaggctccggtgtgtgatgttccccgccctgtgtccaagtgttctcattgttcagttcccacctgtgagtgagaacatgtggtgtttggttttctgtccttgcgatagtttgctcagaatgatggtttccagcttcatccatgttgctgcaaaggacatgaactcatccttttttatggctgcatagtattccatggtgtatatgtgtcacattttcttaatccagtctatcattgatggacatttgggttggttccaagtgtttgctattgtgaatagtgctgcaataaacatacatgtgcatgtgtctttatagcagcatgatttataatcctttgggtatatatgcagtaatgggattgctgggtcaaatggtatttctgcttctagatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgaggtggtatctcactgtttttaaaactcattacagagctaagtggtttttatttaatgtaaatttatatcacattacttttctactcaaaactccccaatggtatcccattaaacttataaaatttcagttttctttctggctcccaaatttctttttttttttttttttttttttttttgagatggagtctcgctgtcgcccaggctggagtgcagtggtgcaacctcggctcactgcaggctccaccccccggggttcacgccattctcctgcctcagcttcccgagtagctgggactacaggcgcccgccacctcgcacggctaattttttttttgtatttttagtagagacggggcttcaccgtgttagccaggacggtcttgatctcctgacctcgtgatccgcctgcctctgcctcccaaagtgctgggattacaggcgtgagccactgcgcctggccccaaatttctttatgactaccttctgcctttgttttttgcatatcacagtttgtcattcctccttccctctttttccctccctagtgcatttagttgaacaagccaagcccatttccaccccaggaactttgcacttgttgccaggttcctccaggtccaggtcttcacatgatgtagacattctcatctatcactttctcagaaggatgaacatgaccctttaaggtagctcttccacactccagtgactctgtcccattactctgctgtttcctcatagctcttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacgtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaaaaccatgatccaagaaccactgggggtgggacagtggagttgggatatggagaaagacaagctaagtgggatgctgcttttcgacactttgacaaagatcatccttaccattatctcctcataagatacctagaggaaaaggtgatgacattatatatatttggaagccacaagtgtggtacatatttctagataataagaatggaatgagctaacatttattgggaacttactctgtcctgagcactattatctaatttagtcctttcaatatctctaagttactattattttgtttctcttttccttttttttttttttttttttttttggtttgtgttttgagacagggtcttgctctgttacccaggctggagtgcggtggtacaatcccagctcactgcaacctccacctcctgggttcaagcgattctcctgcctcagcctccctagtagctgggattacaggcgcctgccaccatgccaccttttcccaacctcaggaataatatacttaaccaaccagcattaaactccatgcatgagtttttctcatatatgaaaagaagaaaataggccaagcgtggtggctcatgcctgtaatcccagcactttgggaggccgaggtgggcggatcacttgagccattttttgtatttttttagtagagatgaggtttcaccatgttggccaggctggtctcaaactcctgacctcaagtgatccgcccacctcggcctcccaaagtgctgggattacaggcatgagccaccatgcctggcctattttcttcttttcatatatgagaaaaactcatgcatggagtttaatgctggttggttaagtatattattcctgaggttgggaaaagggagtcttagtgaaaacaaaaggtgtattacctaaagggctcattttctacaggaaaattatggtggctagattatgttttattattctctttcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccaggtaagaatgctgggaaggtttttaaattttatttatttatttatttttgctactgcatgtgtttattataatctttgaaaatcattgttgtattacataatagagctgttgcaattatgtttgaaaagcagaagatccctggtgctctcaatcaacctgtcagcctaccttagcctcaaattatctgttttctcccctcctctgaatgaaatacatgcagggtacttatactgtcaactacttctctgaacaattgagtgactgattgaaaattacaggcagatacatttacttgttctctaagcacttgggattcaaagcaattattttagaatgcagtgttagaatagctcttatattctggcacttagtttataataatatgatgtttgtcttagagaaaatattgttttgtgacctggatatattagaagagatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaatcgaaaattaaaaggacatttttatttgaattgtaagggataaaatactgctatgggagtgaattgtgaggaaataaaatttaggaaaggaattcttaacggaaatgggagataaggggcttggtgatatgtgcatcacacaatgtggaaacctttagaaacagcgaggacccacatgagacaagtcaggtctggttgatggtggccctgccctgatgtgctctctggcctacagggctcctgtactgagtcagaacccagtttaaaaatagcattgtacagccgggcgcggtggctcacgcctgtaatcccagcactttgggaggccgaggcgggcgggtcacgaggtcaggagattgagaccatcctggttaacacggtgaaaccccatctctactaaaactacaaaaaattagccgggcgtagtggcgggcgcctgtagtcccagctgctcgggaggctgaggcaggagaatggcttgaacccgggaggcagagcttgcagagagcggagactgcaccactgcactccagcttgggcgacagtccgaggctccatctcaacaacaacaacaacaacaacaacaaaatagcattgtacctcactaatcaccaggaaaatgcacatcaaaaccacagtgagatatcacctcacacccttttctatgactactattaaaaagtgcaggatataaatattggctaggatatagagtgattacagcccttgtgcactcttagtgggaatgtaaaatggtgcagccactgtaggaaagagtatggcagtttcctcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagtatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcacttgagtctagaagtttgataccagcctgggcaacatgacaaaaccccatctgtacaaataatacaaaaattaattaggcgtgatggcatgtgcttttactgccagttactctggaggctgaagtgggaggatcacctaagcccagtagttcaaggctgcagtgagccatgatcacaccactgaactccagcctgggtgacagagcaagaccctgtctctaaataacaataattattctaataattttgaatgatgtaaaactttattaaccccaagtgttcttctacatcagtgattgtcaaaatgtgatcccttgaccaaaagcatgaggttcactagagatcttattaaaaatacaagttcttgtgtcctaactcagaattactgaatcagattgttaaggtgaggcccagccttctattctagatcctctaggataagatggtatcctagagttgggtcaattaattccccttcttactattctcacgccagttgcatcttaatgtctaaggattcatgtattcggcaaatatttaatagtcagttaccctactcgagacacttctgtcagaacggttcagagaaccaaagagcaaagctgtcgcatacttgaacgtgtatctagtatgacaacagataataaccaaacttagaaacaattatgctctaccatcatgtagcactctaaatgataatgagggctgtgaagataagggtgtgaccttacccacagaaatatggtgaggtgccatctgaacaaagatgacagcacagtgaggaagtgagcctcatggagcacaggtgaagctgagcctggtcgtggtccacgtttatgctgaacagaggtaccaactcaggagcacatgatgtaggagcaaaaagataacacatttttcataaccatcacaaggggcatggctgatgtttctataacaaagacaggttagcaagagaaaaacccagggaaaacttgagattttatgctaagttgaatgaaagaaatgaatagatgtgactaaatagaattggaatgaaatatgatctaaccgtaatcaacagacagtggcggggggactcagcaagtcctgtatttttggattcttcttgctccctcggtgtagcatttcttccctctgcatatagggcaggacacctgtcatatgaaagtctatccgggagaagggaaaaggtcagtgcgtgagctttctaggttttaaggcttgctgtaggagaggatttcagtttctttgactcacctggctgcaggacacagggcaggggattggagaagatcagaaagaccttgtttctgaggccctctcaaatctccttcagttccaagtactcagcattccaaggcactgtattttagaatactatgttctgacccccaacggtgttgaaatttccttcttttttgttttgacaagatgtgaattcatcaggaaaccagtgttccctatcttattaaagccttccaagagcatctaaaaatggtaaagcatgttggattatttttggagactagcataacaccaagaaaataaactttctttagcagttctgaacaatgaaaaacagaacagaaataaacaagttttgaacaaatgaaaggatcacaactcccaatatgagatttttttttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagatataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaagccaccatgccaggcaggattagcagttttaagaatctttgctcattagataataaaataattattccattcttctttgaatttgcagttcttagacaaccgttggagatagttttcataaactccttggtcattgctttcctttttgtcttaagttgctcataatgtatacatttaattttaaactaaaataaatataagtggtaatgtttcattttttttctcttaaggatataaactccttctctcatatatcttaggaattttaagtgaaaatgtccagttaatatagctggctaatagcagaaccagaaatgggttccaaatattgtgactgctagcccatgtgtcttgactcaatcctgcttttacttttttaaaatcactcaattgaagtataatttatggaccataaaattcatccattttaagtatacaatttaataatttttagtaattgcatatgattacagtaccattataatccaattttagaacatttcttcattccatttttttatctctagcctaggcaaacagtaatctactgaacttgctgttattttgatctatatagaagattattaactcaaagaatttttttactattaaactatatttggagaaaaaaaaacggtgctgctttcaatattcttttcatagtcaaataaccctctccttcaatcttaccacacatccaggagagagatcagtaaattgacacccaactttagtagactttagtaagtacttataaaatttaaagttatccaaacaagatcttttataattttgcacatgtaattgtttggactcagataaaattggcatagcaaaataatcatgcttcagtttgtctccagggcttccatataacataatagagagcctcttaaactcaactgcttttaggcttagaaggctgtgacagatatgagttatcagtgcatgaaatacaggaaagcatacttttctctataaactagaatcttttattcaacaacagataaagatatgttaaataaaagattttatccagctataaaaggacatgtatttataactgtaattttgatagtctgataaatctctaactttcataagaaaacaattaagagtattccttagttaaaagtttaattttgtagacattgagacttttttttttttagatggggtctcactctgtcacccaggctggagtgtagtggtgcaattttgactcagagcaacctccaccccctgaactcaaagaatcctccctcctcagccccccaattaggtgggactacagatgcataccactacacccagataactgtttgtatttttggtggagacagggtttcaccatgttgcccatgcttgtctcagactcctgagctcaagtgatctgcccatctcagactccaaagtgttgggattacaggcgtcagccgccatgcctggccaatattgggagcctttcatgttacttaaattctgcatttagtggacatatttgtaaccttgttatttcatttgcattggactgtctgctccctgagtgtaggaactgtcttctttctctgtgaatgtgtgggagtcacctaggcagaccttagtgtggagtgacgtccaatcatgaagagggaacagcatttgcaaacacacaagagaaagcatagttactttgatccctaagaatagttttacatgatcaaagaatgtcatgtaaaaagctgggtattggtaaatggtaaataataaggtacggaatagggaatatagggtactaggatgattggtataatagggtgaagagtaaatgagtgcgtgtgggtacctaacagtaagtctgaagaagtaaatgtaatagaagtggaggtaaaggaaaatattcagtaaatacatgaaatactcattaaataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacgcatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcattgacaaagaaagaactctagaaagagccagagacacagaagaacaaggaaagtgtcgtgttctaaaaccaagggaagagacatattcaaagaaatcagagggcttgccatcatcagctatcacaaagactgtataagcctttcatttagcagtcaggagagctttattaaattgtcttaactttaacagcttcactggaatgacaggcagggaaactatgtacatttctagatgtcattgaaggagtaaagtatcggaaatgagatttttaggcttcttttccaagaaaccttgctgtaaaaggaaacataacaaggaacaaaaggaaatgaatgaatgcttttttcaagcaaggtgggggcttgaatatgattgtgcattgagaagatggtatgggaaaaaaaagagacagacagacagataacagaggtgaatgtgattttcagccaagcagagtgcatgctggatctgttgtctattcccacctttttcagctcatggagcccaatattctaagataatgcaaattgctgaagacaatctttccctactctctaaggatatattggccccaatgtctaaggtcaacattagccagattgagattttacaaagaaatctcaaggtcccaaccaacttttccatatttttgggcaatatgataccaggcataacatacctcagccacaggacaaaggactgggaatagaaagattcttacaaggagagtacactttcacctttgcctgggacaatgtttggtcttttctgtcttgccatatgaactctttcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagtgcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgccacaacttaatatgtatttaagaaaatatgtttaatagaaaataggtttaaaatgaaaatatgtatgtttccatatatagagagagatggaagaatatatattttcttttttaaactaatgccatagttcaattatttaagccagacagctaaaactgcttctttttgtccaagtatatggctcacccctgtaacccagtactctttggaaggctgaggcaggaggatggcttgagtccaggaattcaacaccagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtccaattttggtgattatgaatagctactattaacattcatgtacaggattttgtgtgagtgtaaattttttatctaaattttttttttaagatcagatagtaaatatttcactcttgacaggtctcatgtattctttttttatttttatttttttagaaaaggtcttgccctgtcacccaggctggagtgcagtggcataatcacagctcactgcagccttgatctccctggctcaagcaattcttccatcttagcctcctgagtagccagggctacaggcgtgcaccaccacaccagtctcattttttaactttttgtagagatgaggtttcactgtgttgcctagtctaatcttgaacaaagctcaagcagtccttattccttggccttccaaagtgctaggattacagatgtgagctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatgtctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattttggagctttttgtttttttgttttttgtttttttaaagagacaaagtcttgtttcgttagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttgaatcaatgatatgaaaatattttctcacagtctgtagctatctttttattctcttattagcgtctatcacagaacacaagattttaactttgaggatgcacagtatatttattttttcttttatggattgtgctttagttaccatgtctaaaacctcctcatctaaccatcagtcttaaagacttctttcgcccataatttatttagaagtgtgttgtttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctacgatatctaaacaggagagcattctaataaaacccctaaactcacctggccttttagtagaatattatctttacatacagatatggaggaaaatatgttaaatgtaaattcttttttcttctctctatcttcatttatttatttatttatttgagacaggatgtccctttgtcatctaggctggaatgcagtggtgctgtcagagctcactgcagcctcaacttcctggactcaatcgatcctcccaccacagcatcctgagaagcagggaccacagacatgcaccaccatgtctggctaatttttaaaaatttttccccaggctcagtgtccagctcctgggctcaagtgatctgcccaccttggcctcccaaggggctggaattacaggcatgagccactgcacacagctgaattcttttcaaaaccagcaaatcatacatttctcatagaagttaacttccacagagatgttttattttctttttctttttttttttcatacttcgaggccaaaaaattgtcatcaagatcctagcaattgctgcagccaatcccaggactttgcttccacagtagctattgagcatcaaatgctctcttagatcatagaccacaactttgatgagctttcattcttagctatgtcttaggattctcctgaaatatgaagggtaggaagttgtattccctagttcaagggaaaaaaaaaatcaatttaaattcaatggtattaaaaacaatgaatatttacttcaaaaaattattataaagcaaaatatggtacaaactagtttttccttctaaactcaaatacctagctagtaatattccaaaaataaacattaattatatggaaagaatttttaaatttttgcaatgctgaaattaatcagtgggaatactgacgctcttacctgtgggtctttgttcttagagctcccaagatggggcgggccgctcccaagatggcagcaagccttttgttctctgaccttgggttcttggcctcacagattccaagaatggaatcttgggccatgcggtgagtgttatagctctattagaagctgtgggtcacggaagaaaaccatggaacccagcgactagtgttcagcttgattaggatgaacccaggcacttagctgtgcaggaacaatggtgagcctttagcccgatcgggagcagaaatgggcaccttgctggatcaggagcacagcagacactctgctagatccagaggggtgggagtcaatggtgggtctgagatggtggcaaacagcagtggtggacccgggtgggagtcaatggcaggtctgtaacagcggcaaacagcggtggtggacagtgagcaaaagctcagctcaagccgtaacaaacacggaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttctttacctcctgcttttagcctaatttgtgtttcagtgagccctctttactacccgattggtcaggtgtgagctgagttaccagccctgtgtttaaaggtgggtgcagtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcaattgagatttcctcaggaggagtgcctttgatgtcatcaacataggagcatgggctaggaggctgtccaggggcccacagtagatcttagtcatgcatctggggctccatttgaagaatgatttgtagttttatagctttgattctggaagacacaaacttaacaaggaggttaaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccgtgcaggaacaatggcaagcctttagcctgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgagagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggcgaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtccttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttccctttttttaattctagtgcccgagtgagggctattagttctgccagccgagagctagttcctggagtgaggggattactttcaagtattccattattactgaccactgcatacctcgcttttgaagtcctttttttacaaaggaattttcattaatatacaagttgagttagggattagtcaagggaacctctagaaggtccctcgagtggtataggtttgaacaattacctgttgacagttatgttttatctttttcattgtttggaagaaatgtggcggggttaagagttgcgcaagtatgcagttgcagcactggccctttaattaatagagcctgatatttaagcaaacgattgtctgacagccacaagtctcctttagcagtgagtatgctgtttacatcatgagatgtccacacagtaagatctcttccctgtattattttaactgctttacatactaagactgcaactgccgccactacccgtaaacaatgatgccaaccctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagcctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagtcttgagctaatgcctggccaaatagatgtgggctatctcttaacccttggggtaaaacagtccaggtgagttgagacattgggtttgaagcatctttaaaggcaaataagaattgagaatcagaatgtacagggatgcagaaaaaggcatccttaaggtccaggactgtaaaccactctgcttcctctggtatttgggaaagcagagtagaagggtaaggtacagctgggtatagaggaacagcagcctcactgataatcctgacatcttgtactaacctccactgtctattgggcttctttactcctaaaattggaggattgcaggggctattgcatggttttactaggagtagggcttttaggtccttaacaattttttggagtccttgttgggcctcgggtctaagggggtactgcctttggtagggaaaggaggtggaatcctttagtttaactagaacacgacgggcattatttgctcgtccatattgtccttctgttgcccagactttaggattaattcctttttcaagcaggggacaacaaacgggtgttccttttcctatgttcaggtgtataatggtccctgcttttgttagaatgtctttccctaacaagggagtggggtttttaggcataattagaaaagcatgtgaaaagagtaaagttccccagtcacagcttagtggctgggagaagtatctagtggctgtcccaggaccccttggatagtgacagatctggagacagttgtccaggacaggagagtaagactgagaaggccacgccagtgtccaggagacagttaacctcctggccctcaatggttaagcatacccggggctctgtgagggtgatggcatgggctggcgcttgccccaggcaccctcagtcctgctgctggatcatctggttagtggcttctgactcagaggaccttcgtcccctggggcagtgggccttccagtgattcccttgacataaggggcatggacgaggggggtggcttatttctattagaacaatcttttttaaagtgtccttgtagatcgcactggaagcaagccctattaggcattcaatttgtccagactttccctgttccagagcctccgaagtcgtgcttgcctgagggccatgactaaagtggtggccttttctttatcccgtttatcctgttctgcctgctcctcctgatctctattataaaaaaccgaggttgccaagttcaatagggtttctaagttttgctctgggcctaaggtggacttttaaagtttttttctaatgtctgcagctgactgagtgataaacttaacctttaagattagttggccttcaacagagtcaggtgacagagagtttgcttcctcaatgcctcccttagtctctacagaaaggcagtaggattttcttcctttccttgtgttatagtgaacatcactgaataatctataggcttcttcctagttttccttagtcctttagcaagcaagttagcaaatgtctgtggcaccaattccatgttctgattctgtgtcccaatgagggtctacactgggaactgcctgctggcctgtggggaattgttctttttcctctgttgtcatcctatcattgacctgactgagataccagagatcaccaaactctcaggctgcagttatggcagcacttctctcatttgggattagtgtctgatctagcagtaacattatatctctccatgtcagatcaaaggattgtcctaacccttgtaaagcatcaatatagccaacagggttatctgagaatttacctaggtctattttaatttgcttcaagtctgacagggaaaaaggtacatacactctgacaaggccgaattctccagaatacattttaggggtgtttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacctggctgcccatcaagatgcattcccataaacaacagttcttatgcaaattcgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattagggaattctcctaactcttcttccacaagagtctcactatcaattaatgaatacccattgtggtttttttctcaatcacccgagaggaagcatctatccttgtgtcccgaagggagttcctcctaggtctggtaggacctttgtatggtaattaagatttaaatcccctgttaggaaagctgctaggttaagggaattttcagtggttagtgttaaatcaccgttttctaatagaatagcccgatactttaagatttttgagttagtaagctacctttttgcttttttgacttaggatagctctgaactggttatgtgtgctcacaataaggtttcctctaaaggttatttttctactttcttctgttagcaaagcagttaccgctactgattgaatgcatttgggccatttgtgggttactgggttaagaatttttgataggaaggctacaggttgtcagtggtctcagtgtttctggctatgcccttgtttacactgacaacaaggtagtattggagtattatagggtcacagagaagaccttcgattatcaattataggttttaaatttaccctggcttttaaaggaatagggcacactgtttttctttactacttctatctttctatttctttctctctctctcatctctgtctctctctctctcctctctgtctctttctctcccttttctctctctctgcctctttctctttctctcctctctgtctctctctctctctcatctctgtctctctctctgtctcctctctgtctctgtagatggattttggaaaacagcagaaggaagttcgcttgttgaccccatttgccactataggaatatgtgcctccctttagtttactcaatttgctttcatcctgatctattatgttgttgtagacccagttccagaagttaaagtactaggtcatcagttctaaggccctggccaaggagccaaggcttgaagattgtattgaagattgcattgtggggtggtgggtcgggggatgctgggtagaaattaggggaggagagcatcttaaacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagccgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctgggtttatatcctgatcattgtccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcaattaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgatctattttctaattatataattcaaaaaattgtttcaggaatattattctaaccagttttaaaagtaacatatcaatatatgtatgacattaacattaatggcagtttgtctctttcaaacacagactatctggtacttgtatctaacaatgtatttacaattgtgatcatatatggctagtgttgatgctattaataggatgttccaaacatatatcaagtttttttttttgtggaagtcattatgataggtaatccatatttgtagaagatataagcctttacacaaagactttaacataattacaattcagattaaaattagctttattgggatgccaacaatgaatatattaaagggacatacaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccacttaaaaatgagaacatatagtatgcagttctctgatcatgcattaattcatttaagataatggcctctggctgcatccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaatttacattcccaccaatgatgtataagtgttttatttctttgcaaccttgtcaccatctgttattttttgatgttttagtaatagccattctgactggtgtgagatggtatctcattgcagttttgatttgcatttcactaacaattattgatgttgagcattttttcatatatttgttggctgtatgtatgtcttctttcaagaagtgtctattcatgttctttgcctttttttttttttttttttctttgagacagagtcttgctctgtcccccaggctggagtgcagtggtgtgatctcggctcattgcaatctccacctcccaggttcaagcgattctcttgcctcagcctcccaagtatctgggactacaggcctctgccaccaaacctggctaattttttgtatttttagtagagacggggtttcactgtgtttgccaggatggtctcaatctcctgacctcgtgatctgcccgcctctgcctctattctttgcccattttttaatggggttatttgtttctcgcttgtcgaattgcttaaattccttatagagtctggatattaaatatttgcaaggaatagtttgtgaatatcttctcccattctgtaggttgtctatttactctgctgatagtttcttttgctgtgcagaagctctttagtttaattaggtcccacttgtcagtttggggggtttttgcaattgttattgaggactcagtcacaaatcctttgtcaaagccactgtccaggatgatatttcctaggttttcttctaggaattttataattttaggtcttacattttagtcttatccatcttgagtcaataattgtatttggtgaaaggtaggggtccagttccattcttctgcatatttctggctggttatcccagcaccacctattgaataagagttcttaccccattgcttgtttttgtcaactttgttaaagattagactgttgtagatatgtggctttattctgggttctctaacctgttctattggtctatgtatatgttttggtcccagtaccatggtgttttggttattgtagccttgtagtttgaagtcaggtaatgatgccatcagccttgttctttttgcttgggattgctttggctattcaggctctttattggtcacatacgaattttagaatagatttttctatttctgtgagaaatgacataggtagtttgataggaatagctttgaatctataaattgctttgagcaatatggtggttttcatgatattgattcttccaatccatgagtatggaatgtttttctatttgtgtcatctataatttttctttgagcagtactttggagttctccttgtagagagctttcacctccttggttagatgtatttcttagtgttttactgttttttcgctgttgcaaatgggattgtattattgatttggctctcagcttaaacattcttggcatatagaaatgctcctgattttttaatgttgattttatattctgaaactttactgaaattgtgtagcagttctaggagaattttggtggagtctttagggttttctaggtatagaatcttatcattagtaaagatagataattttttttctatttagattccttttctttctttctcttgactgactgccctggctaagatttccggtactatattgagtaggagtgggagatatctttgatttgttccagttcttaaggagaatacctccagcttttattcattcagtatgatgttcgctgtgagtttgccatagatcgctcttattgttttgcggtatgttcctttgatgcctagtttgttgagggtttttatcatgaagggatattggattttactgaaagctttttctacatctattgacatgatcatatggtttttgttctcaattatctttacatcctgaatcacatttatggatttacatgtgttgaatcaattctgcatcccaggaataaaacctacttgaatgtggtgaaataactttttcatgtgcttctggatttggtttgctagtattttgttgatgatttttgcttcaatggggatattgacccgtaattttgttgttgttgttgttgttgttatttctttggcagattttggtatcgagtgatactggcttcctagaatgagtcggggaggagtcaccccctccttaattttttgggatagtttcagcagtgttggtaccagctcttctttgtaagtctgatagaatttggctatgaattcatctggcacaggactttttttggttggtaagattttatgactgattcaagttgaaactctattggaatgttcagggtcttagtttctacctggtttagtcttgggaggttgtatctttccaggaatttatctatttccttcagattgtctagttttcatggataaagtgttcataagagtctctaaggatcttttgtatttctttttttttttttttttttttttttgagatggagtttcactcgtgttgcccaggctggagtgcaatggtgcgatctcggctcaccacaacctctgcatcccaggttcaagcgattctcttgcctcagcctcccaagtagctgggattacaggcatgtgccaccgcacccagctaattttgtatttttagtagagatggagtttctccatgttggtcaggctggtctcgaactcccaacctcaggtgatccgcccacctcggcctcccaaagtgctgggattacaggcatgagccacagcacccagctgggatcttttgtatttctttcttccttttttttttttttttttttttttgagatggagtcttgctctgtcacccaggctggagtgcagtggcacgatctcggctcattgcaagctctgcctcccgggttcacgccattcacctacttcagcctccaaattagctgggactacaggtgcccgccactgcacctggctaatttttttttgtatttttagtagagacagggtttcaccatgttagccaggatcatctccatctcctgacctcgtgatccatccacctcagctcccaaagtgctgggattacaggctggagccaccgctcccggctggatcttttgtatttctgcaggattagttgtaatgtcatctttgttgtttctgactgtgcatatttgaatcctctgtttttttctttttaatctagatagtagtctgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaatttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggctaagtgttgaattgaagtctaaaatgtctttgttagttttctgacttgatgatctgtctaatgctctctttggggtgttgaaatccctactagtattgttaaccatctaagtcttttcataggtctagaagtacttgttttatgaatctgggtgctccagtgtttgctatgtatatatttaggatagtttagtattcttgttgcattgaacattttatcattatgtattgcccttctttgacctgttttattgctattggcttaggcagtctggccactccttggcaccattacagtagcttctactggggctatggcagctgatgcctagctgctcagggatccaaggcctgtgcggctccactgggcttaagtggtacccctgcaaagattccaggctggtctctgtgttgatttggagttccactgaggtcaagggcttctcccatgcccaggattgcaaaggtccatggcagatgtttggatcccctgggaactctcactcatcaaccctttcctgacttagggaactttccccaggtctgtactggtcccaggtgggcaagtccttggctttgctcctctcttctctgtgagtcctcttgctttcttgttgaatcccaacatgacatcttagatgatctacttgaagtcgtagcatttactcaccactttgttttctctccatgagagcagcatatactagctacttctagtcagccatcttgagcacctcacctgttttccagattggaaaactgcccatatctggggagctctgcatttttctttagagtgcttcacagatactgcattttttacaaattaaaagttagtggcaactccaattccagcaagtctataggcatcatttttccaagaacatgtgctcactttgtgtttctgtggcacatattggcaattctcacaatatttcaaactttttcattattatatctgtaatagtaatctgtgatcagttctctttgatgttattattgtcattatcttggggcaacatgagctatgtccgtataagatggtgaactttatcaataaatgttgtgtgtgttctgactgtgctagagaccagttgtggggatatgtgagggcagccatgttgccaggcacatgtggggacaagaggaagacaagggaaatcaccatgtttggtggacccagtttctaatggcctttatttgcatattaaagcttgcctgcaggctctaagagccggggctttcctgttagacaagaaacatttctggagctgctttaaaagaaacaaaaacttcccaaggacgccttttcatctctatctgcctaaaataatttcttaataactcctataacaaaaatatactgcaaaagggtcatacctgagaagtctgcttgttgagttgtggtaatttttgcataaatattctagaaatatattgtatgaggtgggaagtggtggtagtgagcagatcgtgagacatcagcttaagtattcattaactacttcaggaaactggagattggaggtctccagtgggaaggagattttcatgaactcagaaaaaatacttcataagggaaagagctaaccaaaaagcaccaaagctggactaagattttcttgcctttctttttccactccattggaggaataagaagcagcagcagtgaggaacaagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaaagggggaaatcgggaaacacacaggcatactgggagaaggccaaacacacaagagatggccatctgtaagccaagcagagaggcctagaacatattcttccatcacagtgcttgaaagtaatcaaccttgtcaacacttgattttggactcagagcctgcaaaattgtaagacaataaatttatgtttaagctacccagaagctttagttctagaagccctagtaaactaggggggcttgttacatgaagcaagtattcccagctcaaggaggatttactgaatgtggagacttggctgatagggggaactgatgaactcttttaacatgcccaatctgtgccagaatttgaagtgtgaccctaagacaaggctcaaaaatctctgccttctttttggaataaagtttttaggatcactgccacatttattttttaattatctatggcttttttaatcctatcataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagatcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaagaaaaatgtaataatatcacaatctctacaataaatgttttagcatagcactaaacccacaatatgctaaaaaagttgtcagtagaggagacagaaaataatcctaaagaacaggattgactggtgtacattaatcctgacttgcctttgggaaaaaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatctataaaagggatcaggttgaaatagatggtatgtctttaaaaagtctttaaaggtttaattaagtagtctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtacttgctaatttagatttcctcatggagcacagtaaatatgagagatcctcataatagcctctataggtttaaattatattttaaatgtaaatgcaaaacttaattattttttagaggacctgatgtcatccttgggagtaatttttaattactttttatccttcttagagttgattgtattaattatttgtactggcttaacaataccatactgaaaaagcttttatttttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcctccctatcattccaaaatccacaatggtcaagtcccttatatacaaatggcatcatatttccaaagaacctaggcctatgccatatactttaaataatctctagattacttataatacctaacacagtataaatgtcatgtaaatagctgttatactgtattgtttagggaatagtgacgagaaaaaaagtctgtacatgtttagtatatatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatttcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccgggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttacactgtgcaaatgattacaactatggctattagataacactgtgaagttcttaattttagtgattaagaacgtaatttcacaacttgatgtaagaatgatagtttatataatttattaatcatgttataactttatctgcataacttttatgcataatttgcaaaatacataccaccacatttgctctagcaagttttagtatttaatgaatgggggtcatagttaataaaaatggttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttcagtgggaaaatatgaaagtttctattgggttttttcatcatgatgctaatgggcagtatccttcctagctggaagctcccaagagggagatgaatggcagctgaatttgtacctccaggtgctaaggtccatctacctctgaggatgggtcagtagcagctgtatttttaggaggctttgcttaagtttagataaatttctttctgtggctgctctttgttcagatgtgttcaaagtagtcagaccaggcatagtggctcatggctgtattcccagcactttgggaggccaatgtgggtcactttagcccaggaattaaaaccagcctgagcaacaaagagatggatgcagtggctaccatctgtaatcccagcactttgggaggctgaggcaagcggaccacaaaagcccagtagttccagaccaacctgggcaacattgtgagatctcaactctacaaaaaaatacaaaaattagctgggcatggtggtgcatgcctgtagtccaagccacttgagaggctgaggtgagaggatcatttgcacccagaaggtcaaggctgcagtaagctgtgattgtgccactgtactccagcctgggctacagcaagaccatgtctttaaatacatacatacatacatacatacatacatacatacatacatacatacatgtagtcttcatgccacttcagtggtctgttggtctcttcagttttcattctcactgttgccttgtttttttgtactaaaatcaaaccctgcatgtgttcagttgcctctacatccagggcctcccattattgtggtaaattttatctgatcacttcttcctctttgcctccctctatgccacttctgctctacttcttggttgatactcaagccaggtcagtgactccctttcttcttgaccaatggaagattatgggaatcactgagtcaaagaggattacacacttattaaatactacaatgcacattgaaagtagttgcttagttgaaaaagataatgttaaaaatgtataatcttgaccaggcgtggtggttcaaggctgtaaccccaggactttgggaggccaaggcaggcagatcacttgagttcaggagtttgagaccagcttgggcaacatggtaaaaccctgtctctacaaaatatacaaaagaaatttagctggatgtagtggcacatgcctgtagtcccagctattcgtgaggttgaggtgggaggatcgcttgagcctggaatgtgggggtttgcagtgagctgagattgtgacactgcactccagcctgggcagcagagtcagacccagtctcaaaaaaaattataatcttaacagtaacataaaaattagagtgcttcaacaaagcaagattttacacaggcatatagatgtcaaatctctgtctatccaagtattgtaaagtaggaaatgccatttggctcacggattccatcttctccagttttatggcctattgcagacatattgcctaccacacctaagtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtaacctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcattttcattttcaactctatgggatttctaaagtagattaataacacattgaagaatatatttgttttgcaaaatggcaatatttaggcaattccagtattctgaaatataaaactttttgggtgattatatttatttgatacttaataattataagtaaaaaggttttgtaacaagaagaagcaacaatatgcctgaagcctatgggtctgttggaatgagtaggcaataggcatgaagtatttgggaataatagtttatattaaatatttactaatgacctggattatttaatgaagaataacattggttaataatcataatgccacaattcagctagaacagaaggatatatcagtcctaaagagcatattgtaagctgggagatgggtattatgttcctaaaatagaatcacaatattttaggtcatttacattgtcaaatctgctacataaagggtgttctctctttttcataagagcaaaaacctactacagttttgtctctacagggattcttctaagaactgtgacagtttaggtaagattatttaaagacaaaaatgtccctttgaattaaatatcaggaataaaccacagagtttactttacatggcagtgtgtgtgtgctgacaggacactgataaaacatgccagagagatgtagatgcctccttcagacccctctagtctcatttaatttaaggatttcttccattaaaagcaatagtgtttgaataagagagcactaagaaaatacatagaatggcatgttacaaagatttttcacaacatctttgtttttgtttttctaattaacattctttttttggagtcagggtgtcactctgttgcccaggctggagtgcagtggcgtgatcatagctcactgcagccttaaacacttgggcccaggctatcctcccacctcagtctcctgagtagctacgactataggtacatgccaccaagcctggttaattttttctttaattttgtagagacgacgtctccctatgttgcccaggctggtctcaaacacctggtctcaagggatcaacccaccttggactcccaaaatgctgggattacaggcgtgagccaccgtccctggcctctcaacatctttattggctaatcatcaattggatcatggaaaaaaaattataatgtaatgaaggcagcccatgaaattgtaattatttacttatggaaggaagctttctaaaaacagggccatttttcactttgtgggatggttacagcatggtcctactttaaagaggatccaggtttctattaacttcctaattttacatcctgcaattctaattttgtgagtaaatactcctagtagatgtctcagaaaacacccacttatagcaatgatttattctgtggcagtgagttaactctctcccatgctctcttttcctttccagcatttgtaaaagaagattacatctatgctgcgactattttaagtagctttgtttgaacaatatattttttcttaactttaatactgatgtttataacggcactttaatctacatcaactctttctaatgacaggccactttactttgggtttatttgggtaacactttctaaatacatttcactaccccaggctagtgggctaacaaaatgaagaagcagactctgtgtggtattttaaagggagggagatgccaaaagcattgcaggaagaaacacatccttaaagattattaccacggtgtctaccagagtaaggagtaggtggcataacattctgagatataaattctctgaggcagaacatagaattttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggtagtatgaaatcacccatgatgggagtatttataccttggaaatctgcaaaggaggaaaaacagtgctctagtcctctggtcttaccaccccttttagggagtaccagcccaccagcaccagtttactgacacagattcaacccaggttggtactatacaaaaagcacattttcattcctttctttcaagatgacaaacttttggattcctaaagaattaagaactgttacccagaaaaaatgggttttattcttttggtgagtaacaaaggtctttctggagacatggatgatgctggaaacatcattctcagctaactaacacaggaacagaaaaccaagcaccgcatgttctcacccataagtgggagttgaacaatgagaacacatggaatcagggaggggaacatcacacactggggcctgtggggggtgaggggctaagggagggagagcattaggagaaatacctaatgtaggtgacgggttgatgggtgcagcaaaccaccatggcacatgtatacttatgcaacaaacctgcacgttctgcacatgtatcccagaacttaaagtataataaaaaaaaaagtcagaggaatatatagcaggctcaaatatttatctttttaattgtgaaatcatctttgcaatatttattatgaaataagttttaaaatattgcataattctaaaatatgatttaaaataaattatttctctgtagtaaaaaaaaatagagcaggttttgatcaatagaagtttgattacttggcataagtaaggaggacactgggagttttcacaaaagcagtgtctcccagaggaaaagtgacagggaagttttatggggtgatagggaagaaggtgcatcatctcatgtagaggaagagttccagttgcggagatgcagtgagtaatcacaccagtgcgtagatcgcatcttatggtaatgaagctatagctcctccccagggtggagactttagcatggtaatgaggaaatttcacacagactcgtctatgagttgctggggtctgtcagaagcttgccctaaccaacaaggtgacagcattacacaccaggcttgggaaaaaaacaagtgatagggcaggaggctgtaaaacaggctgatggttcaactttattaaatgttataatccctggagacccccctgcctgcttacagaactatcacattcagggcatcataagatacaacaatgtaacagcactcagaggcgcttcatcttaatcctctgttttaatttcttctatgtttttcaagtgtatttgccttcttcatttcatggaaatttcttgaaagttgaagtactctatgtattttgcatttttctactatgcctcctgggatacttactagaataataaaattgagctggaatgtgacagatgaaattgctagcaaatatgtcaaaccaagtagtattggctttgattattcataaattttgttatttacctataaaatggtatcatgagtataatcacattttatacacttctattaaatttacagattatagctatatttcaatttataatcattttagtctctagccttacaaaatagtatggaagttttagtatagatactacattctacaggtataaaagtagtgttcaaataatcttaaaaattgcaaaataactgagaccaaaaaaattagactctagaatatagcaaaatattaaaataacatatgaacaatctcccccattcctcacaaaaagaaaataaaagaaatttaaaaagagaagttaaaagacattaatcccaagtattatatattttgttttaaaaaggcctgattttatataattactaacacatagaaaggtccacatagaaatgtttatttgctaaagctgatatttgaaataatcacacacatgcacataaaagctaagatatgtttatgtccgttttcaatttcagagcagcctatggtcatgaagtggggaagcgtccttggattacaggagatgagagtattgtaggccttatgaaggacattgtaggtaagtacaaaacactgaagtttttccaaatgaattgtaaagatgttatcatttagttataaacacaggctcataaagtcaaaatcttattgaagaacatagtgattttctattttaatctataatagtaaaaaggaagtacactttcaacttaaatttgttaactcaaagattgctatggtgagcataacaaggttatttatataaaaataaaatatatgttatttttttctgtcatactttaaatgtaatatttatcacacatgaaaaacacatacattgtattaatttataattgaatacatttcataaaaatcaactgaaatgaattttctataatttaactatttgatataatgaacattttcacatgctaaaggtgtaaaacaccaatcatgtttttgctcatttcaatttaatctttggtgatctatttaaattttagcttcatgttactgaaaatgacatagctgatgctgtttttagtctaaaatgtgctatcctaaagagagttatatatactatcggtggtatttaagatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttatttaaaaagtaattattgattttttgctatatgtcatgacttgtgggagctctgaggacataaaagtgaataagggctgggcatagtgacacacacctataatcccagcactttgacagtctgaggtgggtggattgcttgagctcaggagttcgagaccagcctggccaacatggtgagatcccatctctacaaaaaaattttaaaaattagccaagcatgctggcacacccgtagtcccagatacttgagaggctgaggtgggaggttagcttgagcctgggaggttgaggctgcagtgagcccaaatcgtgccactgttgttcagcctggacgacagggtgacaccctgtctcaaaaaaaaaaaaaaaaaacaaaaaacgaacaacactcaccttccttatcctcatagactgccagtaaaggaagatgcaaataaatccaaaattaatgtacatacataagtaaaatacaaagaaatataaaattaatcacactaccaaagaggcataattttccagttgatttaggactgaacacatgcatgtaactactcttttttctaaaacctcaccaaagaattctgaatggaatagaaaaaaaaattacaaagtctaaactgcagaggacaaaatagaatgccaaaggagatgataataatatctggggagttggctcgctgatagacaagtggtaattgcctttctcaaaaaaaaaaaaaaaaaaaaaaaagtaaaccaaatcctaatctcccaatggcaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaagacatcaatctacacatgtgaagtatccataggtttgggggagaggaggggacaggcgcacaggtgggaagtgtagtagtttataggtcataggattatagatggagtcaaagattttctgattggcaatttattgaaagagttaagttattatctaaaaacctggaatcaatagaaaggagtgtctggaggaagataaggggtgatgaaaaccaaggttcttattatgtagataaagtctcataggtggctgcccttacagacaatagatggcaattgtttcccattcatacctgtaaagggttctagtctctcagttcatctcttcaggattggaagggactgaaaagggaaagatttggttatattcttcatattcttgacagatgtaaattttccctcacaacagaaggctttgtagggccactcaaagtatgtcaaagagacatattttggggtaaaatattttgattttcttctttatctgtcatttgatgttacgccagagtaaggttggaaagtaagcttgtcatataggataaaataaaacccatctggtgagattttatggtttgtaggatgttattccccaggcctcttaggaatttgggcaagacagaaaaaaggtcagagtttagtcctcacacctccagaaggtagtgatgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacgcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaaaaacaaaaaataagagaaagactataaatattcagtcttgtttagaaaactaaagggattaagcttattttaaatttttaaaagaaaatttgtcaaccatagctgtaggggttttctgcctgtctttgaaaaaccacacagtaatataatttatattctggcccacaagactgccgccacttcagatgccagtcaaaaatcctagaaaccacccttactttagacgcaccagctgtaaattcagggatttccacagtgccctttgcaggctccataatttgctagagcaatttcagaactttactttcactttactttatgtttgccagtttactataaagatacaactcagaaacagccaatggaagagatgcatagggcatggaaatgagggagcttccatgccttctctgagcctgccactctcttggtacttaaatgtgttcatcagcccagaacctctctgagtcttactgtttttataaagctcaatcccagccctcctctccctctgggaggtcagtgggtagagctaaaagtttcacctctactccctctgatcacttggtctttttgatgggcagccccccatagtgagatgtctctcagggccccaacttaagtcactttattagcatcaactctcctgtgatctaagggagcttgttatgaataacaaaaaatacttttaccacttggaatatccaagggttttagcagccctgtaccctgaactgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagcccaggagttcaagaccagtctgggcaacatggtgaaactccgcctctgcaagaaatacagatatacaaaaattacccaggcatggtggtacattcctgtagtcccagctattcgaaaggctgaggtgagagagttgctggaacctgggagtttgaggctacagtgagccatgatcatgctgctgcactacatcctgggtgacagaaaaaaaaaaaaaagaaaaaaaaaaaagaaaaatgtgtaacttcactcaaatagactcttttagaatgtgtttttttgtgtgtgttcattttgtttgcaaaccccatgcagcttcccgttttgccttggttactaagaagttctgagaaaaatttgatcaagtttgaagtaacaaaaatatttaataaattctaatttgtttctcatctgcatttattgtgttgctactttctatcattcttcctcaaatagttttgtattacaatttatctgaaaccctctttggaagtaagtgtggtttaaatgatgaaataattaaaataattttgtagtaactgcagtaaagagtagcaaaggccaaatttattttttctacttgctagggttactagcagcaaatccatatgggtctgcagcaacctcggtttttgcctctttagaagaaataattcaactgaggggcgtaaggcaggagagatcaaggcaaattttagagcaggagtgaaagtttattaaaaagttttagagcaggaatgaaaagaagtaaagtatacttgaaagggccaagtgggcaacttgagagatcaagtgcatggtttgacctttgactttgggttttgtattttggcatgcttctggaggcttgtgtcccttctcccctgattcttcccttgggatgggctgtcctcatgcacattggcctggtagcacttgggaggggctgcatgtgcagtgtgtttactggagatatgtgcatactcacttgaggcattcttcccttaccagctgaatgtccctagaaggtcacataagagacattaaaaattggccattttgcctcttaatgtacatgcttgagcccactcacccaaatcctgagatattgggaaactgctgatcacgagtttcaggtttttttctatcttttgggagactgtctttccctggcactggctgcaaccaattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgtcatccccactttgcaagagatttgaaattatgttaggattaaaaagacacagagggaagttggttaagatcctcagtctcaagtcaaatacacagagtattttctgtaaacaatgctttaaccctgaaagaacattcttattttatttttcttctacaagacttttggtcagttagttcatctctttgcacatcagtttcctcgttatgaaatgaagagaattagagtaggtaccttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcagagatccatcagagggatcactatctgtggcaacaatatcctcacaaaatgctttttttaattgtatttaatttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttgttttttatttttattttttatttttgagacagagtcttgctctgtcacacaggctggaatacagtggtgcaatcagctcactacagccttgatttcctgggctctggcaattctctggcctcagcttcccccgagtacctgggaccacaggtacaagcgaccatgcctggctactttttgtatcattggtaaaaatggggtttcaccattttgctcaggctggtctcaaactcctgagctcatccaatccacatgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttctttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctatgttaatcctgaataagattctgcctgtcccttgaaggtttgtagctgagacctcctttctagccataaagtcctagatagcatcttcttccaatagaggactcattcatctacactgaaaatccgttgtttagtgaagcctgcatcaatgatcttagcttgattttctgggtaacttgctgcagattctccatcagcacttaactgtttcaccttgtactttttgtatttcaaatagccaacttgagacaagtttattagtaatttcatggtacccttttgtgggctgattctcacctcacccttccccaagcaactcctgtgactaatgtcaaacaatatgtccttttgttgcttttttcagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgcttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcatttctgctgataatgctgtgtgctataattatatgtaagtttataagaaacctggggtaaaaccgtggactttctcccttttgctggcatcatctacagaaataccatgggcatcatgaaaggcagtatagctataggctgaaaaaagcagggttcagtttgctgctgtcatgatgccctgttgagagactgctcttcaaagtttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaacctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtccctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaatgggagaaattggccaaaacaaaggggctacaggccccatgcaagtccaaaatccagtggggcagtcaaatcttaaagctctgaaatgatctttgattccatgtctcgcatctgggtcatgctatgcaagaggtgggttcccatgtggtcttgggcagctccacccctgtggctttgcagggtacagcctcactcccagctgccttcatgggctggtgttgagtatctgtggcttttctgggcgcatggtgcaagctgtcagtggatctaccactctggggactggaggacagtggccctcttctcacagctccactaggtggtgtcccagtaggtacactgtgtgggggctgccaccccacatttcccttctgcactgccctagcagaggttctccatgaggatcccacctctacagcaaacttctgcctggacatccaggcatttccatacatcttctgaaatctaggcagaggtgcccaaaccttgacttctgtgcactcacaagctcaacaccatgtggaagctgccaaggcttgaggcttgcaccctttgaagccacagactgagctgtaccttggcccctttcatccatggctggagtggctgggactcagggcaccaagtccctagtctgcacactgcaggtgggctctgggtcccacccatgaaaccactttttcctcctagccctctgggcttgtgatgggaggagctgccatgaagacctctgacatgccctggagacattttccccattgtcttggggattaacattctgctcctcgttacttatgcaaatttctgcagctaccttgaatttcttctcagaaatttggattttcttttcatcgtgttgtcaggctgcaaattttccacactcttatgctctgtttctcttttcaaatggaatgcctttaacagtacccaagtcacatcttgaatgctttgctgcttagaagtttcttctgccagataccctaaataatccctctcaagttcaaagttccataaatttctagggcaggggcagaatgtcgccagtctctttgctaaaacataacaagagtcacctttgctccagttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaacattttctttatatttacaacttggctgtttggcacaagagacctagctttcagcctacctcagcttttgacatgtctgcctcactaagcttaatcatgtccagcttttgatttaaagtgacaggcatatgacacttcctttcacttgaacacctaaaggccattgtagggttattgattggcttattttcaatgttgagtctcagggaacagggaggctggagaagtgggagagaaatgggggaagggctgatcagtggagcagtcagaacacacaacatttattgattaagttctctgtcttatatgaatgtggtttgtagcatgccaaaataattacagtattaacatcaaagatcattgatcacggaaataataataaagtttgaaatattgcaagaattatcaaaatgtgatacagagacatgaggtgagcacattcttttggaaaaatggcactgataagatcagttgatggagggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgtatatgtgtacagaaaaattgttcaaatcaggaagggattatttacaaagaattggcccaagtgtgaggaggccattgaaagtgaaatgagggaagctctataccaagtgtaagtgtagtttaattctgcccagcacatctggaggggaacatgtgtgtaggtgcatcacattcccaagccagaaaaattttaggtgattcaaaatgaacactgtattgtttggagaaccaaaatgtccaggaatctgtatcgtgttttgtttgtttgttttgttttttgagacagaatctccctctgtcaccctggctggagtgcactgctacctctcctgacccgccaccttccccaggctcaagcgattctccaactcagccttccaagtagctgggaacacaggcatgcaccaccacatccagctgttttttgtatttttagtagagacagggtctcaccatgttgcccaggctggtcttgaactcctgagctcaaaccatccacctatcttggcctctcaaagtgttgggattagagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatagagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtcaaatggagaaatctatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttagcacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagtacaaacatctaaattacgatatgtttattttacaggagccaatgagaaagaaatagccctaatgaatgctttgactgtaaatttacatcttctaatggtaagttttctttcccactaatgtttagaacacattcatttacagaatctgatgtttttctatctttaattcatgagcttctgggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtatattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttttggcatctctaagtcttagtattttcctttgtaaaaatgagaaacataatatctacctcaaagatctgcatgagaattaaatgtaataatatgtgaaaattgctttagtaccctggccagtgatcaacactcagttaacagtagctatcatcttcgttgttattgttgtcaatatcactctctaggaactgtgtggagaaatgaaagagcttcactgaacaaatgagctactatcaatacaaataagacatacatagaccataatatttcagtgtcatgccatcaaaattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgatagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttcttttgttaaagtaaaacacgtgttaagggaagagaagatggaataggaacattgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttcttattctaaaatctcttataattccttaagtcaaggagatccctctgttttcatctatctcaaagaatgttcagaattctatatgtgaattttattaagtggttcttctctgttgtgtattttgtttaggtgttttaaccttcaccttggatttaatataataatatgcccttatttttactttattatttgttatttcaatgtacttctgtgctctcagcttgatttgataaatacatcatctttcctttttagtatgctattgagtcacaactacaacttcacggacttaacattgaagaaagtatgcggatgataaagccaagagaggtatatgagaaagaaagaaatatttgtcatgctttgtttagtattgatttttttcttcattttcctcaaaagtttattaaaatcttcattactttaatggaactttcaagaaagcatgaaggacctatacttctgttactattagatcattttgcttaaaatagagaataactcagatgtgtatttattttcatttttcaagggctagccatatggcaagcaaactatttttctgttaataccactggattctgccatattcttcaatgggatgggaaaagggtgacaaatttagtatatcattttcaattccaaatgtcatgcccatgggtgccattaaaatcatgctaaagaccagaattatttgttaaaatggaatcgtgactatatttcatgtcccctcttactctaagtatcaaacattttctttgtgtttagactaggatagtggagaaagggatgtggtataatgggaagagctttggctttacagtctggctaatatttccagtgaaatctcagactctccagtttactgggtatgtgactttgggaaagttactttattctctgagactcctttatatttaaacagataacaaaagcatgtgtctaatcaggcttgacctaagatctaaatgtgtactttacattaatagagataaaaggctcacagactttgacatttaaaccctgcagcttgtgtaatttgtcactagtcgaatcatacagaataaattttaggtttcacataagatgctcccagaccgctagtcattgtttggacaattacttctttcaacccagaattactttgaataaattaaagatgtactctattcacttccatttgccaacatacaataaattaatggaataaaaagttctcacatgagaggatataaattgagaggatataaattgttaatttctagcaaaaatgaacatagctgctaataatcacataagtgaccaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtatacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacagcactggagaaaattcatggctgggtgcagtggctcacgcctgtaatcccagcactttgagagtttgagacaggcagatcacgtgaggccgggagttcaagaccagcctgaccaacatggagaaaccccatctctattaaaaatacaaaattagccagatgtggtggcacatgcctgtaatcccagctactcaggaggctgaggcaggagaatcacttgaacctgggaggtggaggttgtggtgagccaagatcgcaccattgcactccagcctgggcaacaagagtgaagctccgtctcaaaaaaaaaaaaaaattatgaaaacttcagaattgctaggatacaggatacacataggtactttgtatttaactaatttttttcagctcaagttgtttgcaagaccaaatctaaattcattcacaacctttagtaagtaatcaattattagttgtagtggcaagatataaggaaaaaaccctctattatagtcagttttattgatatttttcttcttgtttgggtcttgagctttagattagtttggaggagattttaatcttaatctaatagaagatattggctaggtaaaactcagataaaagatgtgtaagtgttatgttttctttggtttagtttaatttagtttagtttttttctgagacagagttgctctgtcacccaggctggagtgcagtggcactattctcgtgcttccgccacccaagtagctgggattacgggcatgcaccaccacacctagctaatttttgtatttttaataaagactgagtttcaccatgttggccaagctggtctcaaactccttacctcaagtgatctgcccaccttggcatcccaaagtgccaggattacaggcgtgagccacacacccggcatgttttctttttttggaaacaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaataataaaaattatgctcaaatgctgctcttatgccagatttttaaagaaccttaatctgaaaaaaaaaactattttataatgcaaaagggctcacggtgaaatttagatcggcaatatgaaattacaaatttattattatcgatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggtctcacctccttagtagcagctgctctgtgcatttgcctctagtcagcaggccaggcaagctgtaggtgatgccattggtactcagctggtcagtcaccaggaagcagacaaaatacttaagataggaagtacatgctaggtctattaaaaattcaactcatactttgtcatactataaatcactctataaatgagttttcacttaatgctgagtatctaaagatgaagaaatgcagaattcaattttatcagtagatcaaattttatacaagttactttaaggaggccattttattcctaagactcttgaaaattttttatactgcctgtaatgagagctttttttcctacccactactaaatcacagttaaattgttttgaagtcatgtctctttgtatgtaagtgtttgtaaaaagtgtttttagtatttatttgaaaaaaaagggcaacattcaacagtcacaatttgtgtttaaaatctttaaatagcacttctatttcattcagcaatcaagccatgtatttaaaaatgtgacaattgaattttattctgaacattaataagttatgggattaatatacatgtgagatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagacatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcccattgaaacacaaaataaatttgtttactttaggttttataagtaaatctcatacttaagtactttgattgctaaagccatttgttaaatgttttgcaggttttctttaacttaaaaaatatagtaaatgcctaccaagttagtctcatagaactctcagtcaaataaatgaaggtaggaatgagcagctttaagtgtaactatgaagaagcaatcaatactatgggaatcaaatggggatatagcagatgtagatttatccattatcaagattattctaacaaatttttaccctcttgctgtagttcctcctattatcaaccaaggtgaggcaaagttctttgaaatgtagacttcgataggtctctctggtggtctggtcatctgtgaataaaactgaagagagaggcagagaagaaattaaaggtgtcaatcaagaaagagataggaaattctaagaacaaagggcatgacacagtcactggtagatttggacatgtgaggcaaaaaaacgttttcagaaataaagcatggtgggaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctataacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccgtagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgagaactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttccctgattattgataagattgagaatcttccaaatacttgttgattttctatatatcttttatgaaatgcttgttcaagtgtcttgcccatatttctatatggttagctttcttttcctggtttgattgtaggtggtatagaaattgattttgaaggagagagaaaatacaagatttcaagtggtcatcaaagaagaaaactaattaataaaaagaacaattgataatatgactttgattcacacaatagatttaagatactgaggcttttcttaactgaggaggcctgagattgtagcaagtgggggaggccaaggaaaacaggttagagagctcaataacaagggaaggccagcatgtggcaagagacatcagtttgaagatgcttcttcaagatgaagatgtgccaacccatctttttggagctctgtcttacttccatgtttctatatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcctctttcattgctcctttttcctttttttctatccctttattcttccccctcgctctcctttctttttgttctctcccttgctctctctctttcttttttcttttatcgtctcatttcacaaagcatttgaaacaattcatggaaaattgacaaggtgaaaataagatataaagcaagaggaatcaagactgtatgcctaaatcatcttgaggtatgaatagactttcccacaaatttagattataataagaaataggaaataaataatgaaaaatattttaataagaactcttgatgtgttaggtagaatagttattggttataaataaatacagtcacaaatgtcttcacagtgatagatgtttatattttactcatgcatcgggcaggaattaactttctctccatccattaattcaggtttccaaaagattcatggttgtgtcctttggcttttgtgtccacagcctctgtctggattcagtcaaaggaatgcacactaacttctttaaagtcttagcttagaaatggcaacatttacttccacttatattccattgactaacactcagtccatgaccttttctgggaaatgaagtatcactgcatgctcaagaacagctgttagttttgctacacctggaactagttattgtgtgttcctgatggaataggatacttattctaagatgcagtatggcattttcattaacagaatgtgtagatcaggaagacacagtcagacctggacttgactctaggtctctacattacttttcagcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaagaataatctaagcagtttggccaggactcaagagactaaactgaagttttaaaaagttaagagatggaacttacaaaaattttaatagtcttatttttaaaaaactcagcacaaactctttgtactcctccatccctttctaatttcatctaaagtggcttaaagcacatggaaacttaaatgggacctagttgttaggaagagccaaataagtatttgttgaatgaatgaatgaatgaatgaatgattcccttaatttctcacatcttttacacattttagtgtacctaatggatgctggcatatttgttttttttcagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaatgatagcccaggcagtttgaataaaaatgaattacttctggatccagaataatttaaggcaaaaatcagaaatacgaataaagacatcattaataaaatcatttagtaaaatcacaggtacccaaaccacatttaaatatgaatatccacctcagtgaaccttctatttatcttcagatagtcctaattattttttaaaaacaattttgagtttattttagaacacaccattgagtgatcaagcctcaaatttctacagaaagcttggccgtgatgcttttagtcctgaaaattggaaatcaactgtcgtaatattataatagaataatatctctgtaatatctctattacagtagaatgatatcaataatacatgggatatcagaacttgagcaattaattagctagaataaatgagtactaaacacttttgtgtacaaatataaattagcataatgtatgaaatttttatccataaaaattaacctctttcataaaagtttaatactggaatgttaaataagtcatctttaccagaaattgttgacattagagacattttgctattgtcactggccattcaccgaataggatcttagtgtataagaagaatcctgtcgctattgtttctatagtagaaccatagaatagcatgcatttggatcttttatcagtacatatttggtcagtaaattataataaaggagttgcaaatagaaacacctaacttaacctggattgtcagggtgagaccttcttaaagaagatgagatctgagccaattatagaatatgggtagaagttatcaggtaaaatcccttctagaaagttaaaaatattggtaggattgcagggaagcaagtatttcagtgtaatttgtgtaattttagaaaagggaggacaagtctataaagcagaccaaaggccaactaaagaaggtcccactaagccatttagctttgccctgaagacccatggaaagccattgaaaggttttagccattcaaagagccatatttatattaattttacaaagaaatatcctgcatatggtgatgagaatagattggaatgaaatacaggtggacgaaaagaggcaattgcagtatctttgcaagaatttgaaaactctctgttgcgtgggcgccgtagctcacgcctgtagtcccagcactttggaagcctgaagcaagtggattgcgtgagcctaggagttcgagaccagcctgagcaacatgttgaaacatcgcctatataaaaaattaaaatatagctgggtgtgattgtgtgtgcctgtagtcccagctactcaggaggctgaggtgggagtatcacttgagctcaggaggtggaggctgcaatgaaccaagatcacaccattgcactccagcctgctggacagagtgagactctgtctctaaataaataaataaataaataaatatgctctgtcattatgatacagttcaaaagatgaaggtatgaaaggacagatccatttcatgcacacaattttttttatctcaggggaaatcatttttattcatcctcattccctcagtgacaataaaaacaggttacgtataagcatcagaaataaagtatctgtactgaactcctgtagtttaactcacctttggttctattcacagaattcaagaaaaagacatgttaaatacacacaaacacacacatatatatatttgtaaatatttttgggtatgcttatatacgtgtatatgtacgtgtatatatatacttgacacattttcagggtgatagaagatatactatatctgcttatgaaaaatgttgattaaggaatttacacctgtattttgatgtaggggaaaatgacataaagcttagatgcaatgttccattagctaattggtctttactcttcactttggaaatagtggaagattgttttgttcagacagatagtgaacaatctgtagtcttaaatccatgcaggtggaagcctaaaatatgtcaaataagtcaaaatatgttggtgaggatcagtgcccaagaatctgaaaattttgagctgtttctaagaagtcttcatcaggtgtttaatttaagcttttgattaaatagaccatttgagaaataatgattaattctcaatggaaatgaagcctggcctccagatgttgttataggattacagatctgggaaaagcaagcctcctggttgtcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttctaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacctggcatcaaaggaagcaatttagaagcagtgtcttcgagaattgtcccatagtgtctatgcaatattatcaaattcagtatgtaaataaatattttaaaataaagtaaatttggttgaggaataggccattcatgttgacacagtaatcagcagaaaaataccttatgggagactgttcctttattttatatctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcctactttgtgcctccttgtcttcctttttagctttccctccacctacatattcccacaagtgaagattctcctttcctctattcccagtcaaccattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagtagagtgttcaatgactgattgagggtagaccttgcaaatttcacagattcatgtgctttgcacatagtctttcatcattaaatacatacctgctagacaagtgaatgtataaatgtgtgtacatcagcagtcaagtggaccaggttgatttgatggaacagtactgcataaaaagcacaactgtattcctgcttaaaaagaatcagaagcttctacagaataacttataatggttaattagtctaaaaaatcaagatgctttttgtaagttttgagttctttttcaaattccacttctattctttgacacacttaggacgtgcagactgctccgttaagtcattaaatattaaatgaactaaattaagcttgaaaaactaccttaagctatttttcccatcttgagtctcagaaataaatcaaacaaactacattttgtgtgaggtccttgctagccagagaaagactgtagaagagaacagcatgactgaatttatttaatttttcttggttttcatacttacttttgacagtaagtaaagacaattatttttttctggtaaaaagaaacagctgaaatttgctctttcaagcatatactttatttaaagtggcgtgattattgtacctgcaaattatacaatggtttaggggctcaggattggtttgcttttcctttcttccaaaccctttactcttatccatccagctgtcagttctctctaataccttctcaattcacacctttcccttaaatttcattagcaaaatgctcattttcttccctcctcttatctctcatctctggatttgacaatcttgccaatgtctactttaagcaagcagagatgaaacagtgaatctagtctctgaaataatgcttcgtaaaaatgtgaatgataatagctacagttgatggcctactgtgtttctggtacttgacatgtatttccaattttcctagcaaccctaacagtaagttttcaccactgctcatttgaggagagtgaatctgagagagtttaagcacttcctcaaggcaatttagctggcaagtaaaggctagaatttgtgtctagctatagctgataccaaagctctctttccacagtattgtcttgtctatatatatatatgaatttgccatttatagtcaattatgtagactacagagacagaggccatatatatatatatatatatatagagagagagagagagagagagagagactgactacagagatgaggtctctctctacatatatatgtatgaatttgccatacatagccaattatgtagactatagagacagaggtctcagattaccaagaaaagaaaggaccaagaaaaagattgtatctttgatgtttgtaatgctgacaccaatttgccattacatgattagtgtatatatatacacacacacacacacaaatcatatatacatctaatatatatttatatataaactaatctcatatatacacattatatatattttgtatgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaactcacaagttttactttgctcctaaatgtcaagaaggcatagcctaaatgtcaataagcatcaaaagtctttctgaatgagatagtgccagcattcatcactgttccttctcagaacctcaagcctactctttccaattaccctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaaccttttatctgtagctatctgcttaagaaaaacaggaaaggcagcttctagtatgactcagctttcagctttttccttttggcctagtaaattgaggtcccagtttttattttcctttcacaccactgaagttgagaagctgtcatttccccctgccatctatttgcataactagagggcataacaatggtgccagattctttgccagtttcccccaaggagtaactgactagctatgtaaatcacattgctggaagccttctggaacttaaacaaagagtaacttgagttacatattaattttaaaaaatgtaaaggctctccttcttgtgaaataaacatagctcaagaaggcctatacaaattgtgatagcttggccatcttcagcatcttcaccatcgctgttcaggaatccagggtttttattgaaagacaagcatcagcttgcttctgtccagcctcttctctccaactacccattctgtgactcttttcccacaggacattcccttcatattttcctttagagtagcaatagttataagctactacacttttttaaaatattagggtatggcttgaaatcagtgggtaataaaattctaatgataaagtcaggagccacggaaatactggtagaagaggcacttccccagcagaggcctcaccctcaagcctggagaccatggccctaaatgagaacagttatccctgttttcctgcctaaatgttgttttttccaaaaccaccctggctcaccatgactgctccccccaccaaatcctgtacccataaaaaccccaaactcctctggcagaggagcagagtggcatggcagaaaaggagagaagaagcatctgaacatcaaagaggcagctggacagtcagagaggatttcagctgggacagccaagctccaggggaaaattagctacctactccatcccctttccagttcctcatcccactgagatcccacctccatcactcaattcaccatcctttaagtccctgtgacctcattcttcctgtatgccagacaaggacctcctaggtgccaagagggcaagttgtaaaagactgtcacctgactccacactgagcttgttaacatttggccatccatggaaggcaactgctgaaagagcactaattgtaacatacccctagatgctaccatgggtctggagcccaaaagcattcaccctggccccagcacacactcgcctgcatgctccccctcccacaagcagctgagtaagtgaagcacacccaggtcgcaaatcctctgaaggggtccagggagctctcccatctccctaattctgtgttagcctaatttgcacaagttgataaataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtgaagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaacctttctggaatctcccaagtatattcatggcatccagttctctagcattagcccacctgagtggcatggagaagtgttgtctctaccagggcctgttgtctcctctgtttgtatatattgacacaaatacagtcattcagtagctctaggacaacggggtttttccaagttatttgttgtgtaaaggttttttgtaatgatcgccttctctatgcacttacattttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatcttatattaactataagagccataggattaaaataagttggaacagtattctggttttgtcctgcagaaaacgtaagctttggttctggttgccgtgtgacatgatttctactaaatttcactgaagctccacttgaagattgtgtctttttcctttttatttgtgttgattttcattttctattgtttcatgttttaatagtgaggagttgctattctcattgaactatactatactgatataaataaatgaagcttaatacattgcataaaatagtagatagctatattaaataatttttggaaaggaattgtgacctgtagaacttactgactttaagtacagcatgaacataatatgcaaataatgcttagttcctactcataaccagagagttgggaggaaaggaaaaataaagagtgagaaggatttttgaaggccgtggcaaatttagtctgcatgaaaagcagaactttcagaatagaaattcactctgaaaagaggcatttacagagatagtggaggcccctcttatagaaatatttactgttgtttttaacttagcacctaagtatgcttttgaatcataacacttgaatgagttctggaaagttaaatgctccaagactgtggcaaaaaaacctaccagctttcatcttcctcctttccattcccaactttctctagtactattcaaaaactccctaattaggaattcctttgggaaattccaatatcagagttaactagccaacctattattgctaatcatttattcctaccctctatataaagatgaccagcatgtgtgcacacacacacacccagacacacatctccctataccgttttctttttttcgttcattttctttaaatttcccattatactttttaaaaagtaatattgtccaaatttatagcactgtagttcttggattgtttcttattacttttgcatcaagcaagaaatgatattcagaacacttaaagttctgattggtatggtatagaagctgcatttcccacagtcacaaagaaggtcatactccatgttaataccaggtagtatccatcattagcctattagaaggtactgatagtcacctggaattcacctaccataatgatagtggcactggcaaaggcattgtctcatccactggagtctgggccagtccctagcagtgaacattcacaggctgatattcgcagacacctctcatgaactcaagggctgcaaccatggttggttagtcaggtggcttaggacaaagactttttatgtaccttaactattttattattttaataattaataagagcgtatcaatgcataccatctatatatcagccccgggtatagtgacaaatatcttatcttgtataagtactatttttcataccaaatttgctaattattaagagtcttcacagttcacaggatttaatcttggtgaaaaaggaataaactaaataataacaataataatagtccaaaatcaatttgataccaaatcaatcaataaagtgatcagagctttaatgctactaggaaaatacttcagctttaccattttatgtttcatttcaataggcaattaatcaaagttaggaaagagtgagctagcttttctcctggaaatttcagcacaggccctatgtatcatattatttcactaattagaaaaaattttagttttgtgttagtgaagatggcaaagacaaaacacacacgatatttcttgttaattgagaatgattttgaacatattctcaactactattttgcccaagatacttcattctaaaagatgtcatttctgaataaagagcacatgcaataaaattgcatcagaaacagaatccctcacataatattcttacaaatttaacatcactttagagaatagctattgacttttgtaagactttattatttgttcattcatttatttttttattcaacaattatttgggttcatactgtgtgagagaagacagtaagattagaaaattgttacaagagagatatacaaacagggcagtagaataagagagaagagaaagatggttaaagaatcttcactcaaagttatctggtgatcaaaatctgagcttgctaggcaaatggaggagagaaagcacatccccaggaaagggaaaagtttatgtaaatagagagaagtctatatggggtatctgaacaaggggcactaacagatcatacagatctttagtcatacccaggagggctgggtatggtggtttatacctgcaataccagcacgctgggaggccgaggcataaggatggcttgagcccaggagttcaagaccagcctgagcaacgtagtgagaactcatctacaaaaacttaaaaaataaaaaataaatagctatgtcaccagaaaagggctcccaatccaagagaccccaagagagggttcttggatctctcacaagaaaggattcaaggtgagtccataaagtaaagtgaaagcaagtttattaagaaagtaaaagaataaaagaatgtctactccataggcagagcagccccgaggactgctggttgcccatttttatggttattatatttcttgttatatactaaacaaggtgtggattattcatgatttttctgggacggggttgggcaattcccagaaccgagggttcctcccctttttagaccatatagggtaacttcctgatgttttcatggcatttgtaaactgtcctagcactggtgggagtgtcttttagcatgctaatgtattagcttataattagcttataatgctaataattagcttataatgagcttataatgctaataattagcttataatgagcagtgaggatgaccagaggtcactcttgtcatcatcttggttttggtgggatttggccagctttactcaaccagttttatcagcaaggtctttatgacctgtatcttgtgctgacctcctatctcatcctgtgacttagaatgcctaacttactaggaatgcagcccagcaggtctcagccttattttacccaggccctactcaagatggagttgctctgattcaaacacctctgataaccataccaaggactatgagttgcattctgaaattaatgggggctctgtgaacaaaggcagtgagtcttataatcaaatgtatgatttataatgtttctgggaggaaggcaggctggaaataatcagaatggcctgaaaatgattgcaagttttggattgactataaagtaaggtggcatggtggctgaacaatgctgtgctggttgtgtcaatatgagtgtgagctgtgtcagtatgagtgtgattgtatcaacatgagtgtgagcacctgtgggtaattttaaataaaatgtgttgaaaaatacttgatttttattgaaaaattgcataaagtagctactcaagtatagagtgtttgctttcacatatgcatatcatgttacctacatgaggcaaaacaatgaaaataactggatggctgtagaaaggttttggagaaccattagatttttttaatgtttaagatgctgccatctagtgacacttttgtgaaatcactttgcagtgatattcatgtttgtatcttccagttcttttctcaatacattttatattttaataatttatattgtctaccaaccaatggggaaataattacaaatgcattaaacatagtgtagaagtcatacttgatttttcaacgtggtaccacaaatgtggccagaaggattttcataatgggatattgtacataaaggtttgtggtttcttcagtgtgccattctttataagtaattgataatgaaagtgctgctttttctatttcttgagttttcttagaaaaattgagttgtaaaaacaaatctgtgaaaatctgagctgtaaaaattgcttcataaaagttgctttaattggaaatgttgaagagaagaaaagagagtttcaaatttagaataattaacttttttccccatatggaatttcagtattataagtatatcttaaaatataaacaaataaatgtgtgtggaggggtgtgtgtgtgtctgttaaagctaaacattagtctccaaacctaggttgtgatgacctgatgacttctaagttttgatgaagattaattatattcatgtcctattactccttaaacttatattacaatggagcacttgtcttattttcatggtacgtattgctcattttctttggtgaggaacaaagaataaattaatctcccttcctccctcaaaatacagttatattgtgctgatatattgtccttttgtgagatactaactccagtcatactatagtgaatgaggttttaattaattaacttttcagtatattgaggtttctttatgcaaaccaatcctatagggtagaggtaagcacatctttccgtaaagaaccaagtagcaaatattttaggctttgtgggccatatggtccctgttgcaacaactcatttctgctgctgtagcgtaaaagcagccatggacaatatttaaacaaatgagactggccgtgatccaaaattaaatttacagaaacagactatagtttgcatgtctcttctctagggaaaacacctgtatttgtaatttggggttctttttttcttaggaagtgttagaacacttctaaaatttatttaagtatttacttcaaaaactttaattccattgagagttgtgtgccttcagtgttccaaaaaatctagtttggagcaggtatgtgcacttggtaaactaatcgtacacatagtaaactacacttggtaaaccagtcatacacaaacccagaggtaaaatgttttgcaaagttctatcacctgcatttagccagtttttaaattcatgttcatgtacaaagttgtcttaatgtggaatgaatctttatattttctcagtaaacattgcaacattttgatatgcagtaagttaaatgactttgatcatcagcaaataaattagaaacttcctacttgggtacaatttggataatatgtattcattgttccagtttgtgcttctgggaatttagtggaaacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaaataacatgggcgcaagagagggcagagaagcagaaccattgatagaatttataacagtgtatatacttgaactgattaaatatgcacatgatgtgggattaaatgctaaacaagaaaactattgactctttcatattactaggatacacttaagcagcagttcagaaactttttagaaaaggaaaccttttacactcttaaaaaccactgagggtcttaggagatttgacattggctctatatctgtatttactgtatttgcaattaaaacaaaattttaaaatgtatttatttgttttagaataacaacaaatgcattacatattaacataagcaaaatattgttatacaaactatgttttctttaaaaaacagtagcattgtttatatatggcaaatcgtattagcacctgacttaataaaagacagctggttttttatacctgcattcaatctctttttttctctttttgaatcttacaaagaaaataggcactcatgaagatatgtaatcagaaaaggcaggagtagttgaatagcctttccgtcaattttgtgtattctttgatactgcatcagaatttgacaagtgagaactttttaggagttctggtatggaatttgaagctgaatcactgaactttctgtactttattatattaaaattcattgactgaacttgcattttgaatagatcctttatcaatgcacaatatgtaacatcgagcattggccattcagaaaatattggttcattgaattatgtgtattttccaaatattgacatatttaatcatataataattagaaattatgtattactactatattcatcagaattatctcaataatgggagctagtcatactcatggaagtggatacaagtttttcaatattctaatttcccctggaaactctaattttatcattggcagcaaatattataagttgttttattgaagtgacactccattttcaaaagaatatctgttaaatacatcacacatgtgaatcgtcattgtttgtcagttgctctttcatgcagaaatggttgtccatgatataaaagtggcaggttcagcttgccactcaaataattgcataaatacattgctttaagatagccatcctacatcagaatgtggtcaagggttttatgtgtacttcccacactcaacattaaaaatatagaattaagatattgagatttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcatcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaattttaaagatttgagttactttccctatttcttttattgtattttctgctttttgttaatcgagttatatgatggaatagtatgataattaatataattctagtatttctatcaatatagagaaattaattcttcaattccttggctgctatgaaaaagtcaggaggttctgtagaaaaatccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccagatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaagcggatggtttaatgcaaagagaccacttgaatattttttttcaaaaattagactttagaaaatttcagattcctcacgttgatgaataaatcaaaggcaaccagagctgtgcctaatagagccttaaatgtggcatgttattattaaaattacatctacctttaaagctgtaaatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatataatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctcacatttctgaagttctgtgcatataaatcctaggaatttaagatgattttctatagtttctttaattgtgtctaaatttttttcaaggttttaaggttttaaacttaagacaacatttgtcttaagtttaaatatctttggacagatatttagtcaaccagacatcttacttgaatatcattatcagtacattagatttccctccatgtatgtcccaacatctctgagaagattaaaaagcaaatattataagaataccatgttttccacatagacagtatgtaagatattgcttgcttttgtatgatgactcacaaccctggccatttctcagtctccatttatttaaattgaaatagaggatctcatgtattatatcaacccaaagggtgagccagtgcccggatagaaggaggtggggtgggggggaagaagtaatatacataaattctagagaatgtcagtgttcggagttaagctttgacctcctagcacacacaggtcttgtacttgagatttctctcagcatggacaaggaacaaggacaaagggattgtattgtgctcacatatgcctcattttgtggaatttcaaaatcttctagacaatgtttaaatctatgttaagtctaagctcccaagagaaagaccatctaggcagaccaggttcacagttcagcttggtctttcaggggtctgtcacctggagaatcttctatgattgttcagtattctggtctctgagctgaggtagtaccagcccctactcataagcagttattgtgagaataaaatgagatgatgtatgtaaaacactaagtgtatcacttgaacatttaatatggtttggatttgtgtccccacccaaatctcatgtagaattgtaatccccagtgttggagcaggggcctggtgggaggtgatgggacaatggggcctttccctttgctattctcatgatggtgagttcttaatgaaatatagttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataa

SEQ ID NO: 2526 - DNA, 752944 bp, Homo sapiens
ataaaatttgtaactcctttttttttaatttcacaaaagttttcacaaggacaacgttatagaagaaaacccccagcagtggctaggtcatgcagaaccattaattgtcataccttggcccattctattcatccttgttgcactttagagagagaagtaagctatgtgagttttacaatgcttttaaactgtcatatttcctgttgagcactttaactggcacattcttatagttataaatgttctgagggcgtaactttataacctcctttgcaaagaatgcatgaagagctcttcatgatccaatactaggggatacatatatatagttatatatatagttatatatatataattatatagttatatatatataattatatatagtttatataaagagatagttatacataatataaatcaatatatagagggacaaaaataatttgaaaaaattcttccactcatagggcttgataatttacatgtatacaattattccccaccacaatactggtttgaatactacgctgcccctgtctttggtgtgggggagggtggaggttctgactgagcctcaccatttgtcagtaaaagtgcttgtcaattcacacagcaagcaaatatccaaaactatcatgcttgaggggacgggggatccaaaatctaaatccaaaacattcaccataaaaacacctttttagagatggtacagctgtgacatgttttcctcctcccttttacccctattctattcgatggaattctttgaagtaaaacttttcaaatatgtatataccagcctagtccatccataagggaaattggttatggtgaattggccagtttttaagaaataccgcactgcctaaagcatgatttgcatgcacaaagcatctgacaactatatgttgaaaaaagggtatttttctacctctcctctcatgcttactaagtgttaaaaaagaaagaaaacaaaagaagaaaaaaataactataccaaaatgtgtttggctcactgttgcactcttcttatcccacgtctcataatgacaaggagcagctctctattgccgtcattaccctgcctaaattggctacattaaagaaagtgatgatgaggaattccttcccaccagctttctgcattgggacagccagcaccgcacagctgtgccaacagttgaaggtggtggctggcttttgtctttgttgagtcaactgtggctgatcctcctacattctaatttatttagcatgtcggctcctagaaaagcatgatctgcagctgggtttgtcttcctctcactctaccattgccccagcccttcctcctacctggcattggggccctaactaatcaaacaaaggggagtaaaaagatcccctgagaatgcatggaaaaatacttgctctttcctgagcattatttattctgtacataaggtaagtaattcaccttttaaaagatgtaaaagtcccaggaaggcagtttttaatgacttacatctgatatttatgatacatatggcttttcatcccaaatgtcaaaagtgaaagaaaaaaaatagctattcatatggcaacataaggagacagaataacaatttaatatgcaatcaaacctcttttcacttaaactaaatgactagaatttgatacatccatgattggaatactattctctcctccatattaaggtgagaaatgttcataagaactcccagagggaactggctctgggacaaaaggccttggtgagtaactaaaaaaatcactgatgttctcttgcaacaagcaggtccttcataatcatctacacaaatcgtgaaagcttttcaaatgcttcgcaatacttcggcccagagactggaaacaatcaatatgttttcattgctgtttggttgcttgtttcaaataaacatgtgctaacttattgtgtgtataaaaaaagaaagaaaggaaaacaacaacaacaacaaaatcaaaacccaaagcaccctgataatcctgataaatcagaatcaacttttcttttacattaaataaacttgctctgcctaactgacgttgatcacaagtgctcccttctaatctgtgaactcgttcctgcagtgagctatttatgtctggagcatgcctttgggttatttttcccccagaatcataaataacttttggtccgtctgcttatttgctgttgtgctcaagggttttatggtggtgaaataaaaatgacaaccacatgcacactatcatacatatgcaaatatgtgtaaaaaaaaagggggggactacaggggaaaacagggaaagttactttgttggaaacaccaactggggaaatgagtggcagatacagtttcacacagtggcggtggatacacatatcaaagccgctcttcctgcacgtacttctgtttgtcccgggactccctggacttgggccggttctgtcggtttgctgtggatgggatggagtgaacagaggagctcttcttgctggaggactgcgacgagtgggaggaatgggacaggctggcccgggactggccggcattgtggtcaaactgcattaagcagaagatcaggtccgtcggcacgagctcaaactcatagggcgggttggtgatgacatacctggacagggaaagcagagatgtcacctcctgagagtaactgagtaaagaattcaactctctctgaaccaaaagcaatggcctggttactcaggactttcagaggatctggaagatgcactcctagctggtctgaggccttaaacattctttttcttgttaaatggaaacttcctctgtttaactcaataaaggaggccagccaggagcccaggcagagatgtggaattagagccagtaatggaagaaccaaacttcgcttctcgtggtctacatgtacctttctatacaaggtcaaagtcactttcaagtagcccaaccgcaagaggtttcatgaagtgtgatgcaactttcatttcataattttcggacaatcccagatatacatcacaagatctttgtttaccatgacagagtgtctccttagactattctcgctctttaccttttaaaatctactttggtgagagaatttggaatttggaattcaccacatggaagaatctaagaaacctgcctacttatcagcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacataatttaaaatatatatatgatgttttcttccttccagaccagttaagttagagtaatcagaatattttttaaaagctccccaggtgattctactatgcaagcagggatgagaaacgcttgtctctgcagcactgttgcctagggtatattatgcaaactcactgatcttggtaattctaggatgtacttttaatttttgcctgctatgaatttattttaatgcatatgagaaaaatataattggcacatctaaactgttatttctctgcttaaggtgataatatataattgtctcaaaaataaatatataaaagttaaaaagcgagtcaatttaaaatatgtgaagtaaaaatatgggattctgagatatggcagaagaaccacttatcttagggcggggtgtggtggctcacacctgtaagcccagcactttgggaggccgaggtgggtggatcacttgaggtcaggagttcgagaccagcctggccaacaagccttctctctactaaaaacacaaaaattggctgggtgtggtggtgtgtgcctataatcccagctactcaggaggctaaggcaagagaatcactggaacccaggaggcagaggttgcagtgagccaagattgtgccactgcactccagcctgggcaacagagcaacactccatctcaaaaaacaaacaaacaaaaaacaaaaaaacaaaaaaacttatcttaaacactagcaatgtaaaatatctctatattaggtaccaacagatgttatcctagtagctagagtttgggagagatgtttgtgtattcagacttttgtaattaggtgatggaattattctattaatacaaaacttgaattcttaccaaaatgtctttacatctactattagtaattatagaaaaatgcttcccatcacctccaaactcagtgttggatttaatatgggcagagtaatttgcatgttgaggagatgtatacagacctttgcctttacagtaggggacaggaaaggatattaatatttctgtgattaggtgggagggcagagttgaaaccaatactcacctctttgtgcactgactgggggtgctgaggtgagcatctctcagccggtaaattccaaaacaaagcatattatatgttttcagagctttgcagaacagatcaccataacaaccaccatcctgggagacagcaaaagaacagagagaaacatcctttttatttgcctgaaaatcaagggacagcagggaaacgggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagattatgcttctccctcactttaagtcaaagtgtaaagcttgatggtctcagatgtatgctcagctgaggagatgaacccttctctgcaaaatggtgattatgttcagtcccagctcagctgtaaccgctgtgataggctcgtgttgtcaaaactgtctgagtgataatgaaaaccaccgcaaggaggaggaccccaccaggtcctatggtgacagactctttcaggaggtaaggaccctgtgaaaagcacaatttacagacctcagagatggcaagggtgcaagagaatgtgtttccctaggagccaggggtctgcaggctgaataactaggattcgcagttctgatcagttcacagccaccttcccggggtctggggcctgatgcagaaagtgaaagcaaatgcatccacttggaaatgctggcttcagcggccaggtggcttcaggtagatgttacctgtattatatgaagggcactgggcactgcgggatggcttcactgggtataaaatgactgtctttgtccttccaatcattggaattctcatattggtctcataccaaagaacactgatgggaccaaatcttaccattatctaaagtctttatcctaatcaagtgcatcaataagtaaatgataggtataaagagccactagctatgaaaattccctttcaaaaaaagcctagtctaacataggtcccagtccatgatcaaactaaaatatggggaaagtatgcagcactgtttcagaaaaaacagagacagaccctttccttggctccttttccactatttagtctttctgggcgacaccattgtttgtgtaacaggtttatcagtttctgtgacttatggctgcatctcttaaatgcatctgtggggttgggctgggaataagggcaaagacagcacacttctgtcacagtgcctacactaggcagatacatggaatcagaagggagacgctggccacttccgtcacagggaggacatgagggaacgtgactgggtccactctcagaaattacaaggtctaggttttgatttacaggcattaaaggatccacataagattcggtttgtttggccggtggttctggatacatctgactactgactaccctggtgctttgaaaaccaccagtgcctgggtcctattcacatataaaaactaagaaacctgcaggctgaggctggccacctccatgtgctattaatgtatagttgggttgagtatccctaagctacgctaagagcctgtggaaatatttcccaaccttggctgcatgctggcatcacctgctgcttctcaccttgtgcagaggatacgtgaagagaacaccaaggagggagaaagcccactggctctgaagccaggatgccttggtgcaaattcccaataggtctagtgctcattctctctgggcctcagttgacttagaaggtgtgatactagaacttatatcaaagggttgctatgaagattaaaatgaatgactatgcatagagcaaagtgtctgatccagagtaaactataaataaatatcacctcttacagttatctacaataggaaggagaaaagccagatgcctagcttgtcacatctgataccacgttcttcaggatcaagcttttcccaaacagcaagctcaggtgacctcggtgctgtggactcacccctaagtccgcaaatggcccatcgagcagagctaactgggccacgcggcagcggtccctattggccagtgtctgcggggtgctgtagccacctctaagggcgttttcctcagcaatcagagcctccagctccggcgtggctcctccggtcaccagggtccgtatcagggtgaggatattgtcattgaagtacgtctggggaaggagagaaagtgagggaaaagtcctttaagcaaacaccctaaagtcatgacagccgacatccaaattacaacttttcttggtatctcctgtttaaagttctggcctgtctcttcaaataatttcatgtggggagtgaaaagacagcagcctccaattattccgttattttctctcttgcttggctctgctacgacagcctgacttaaaaaacccagttcaggggattttttagtaaagggctcaaatctgaataattagtgtttgccataattggttttagtagggatacaaatattgcctccccctcctaaagtctacgtgactactatgagattctggacacgtgtaataaaatgcagcctgccccagctactaacccaagcagcattgtctctgaggccctgtcatccatgtgccaggaagcttcctccccacgacaacggcaaaacctttcattaatgccacacgcttaacgatttaccacatgcgttgataactgtctaactcagaaatctcgatcaattaaatatgccggataaatttatgaaaaggtgaatgtcctggtaagtgtactttggcttttgttttctaaaataacctcagtagtctgaggcaaatatcacttattaaagaagtttccctctaagtgtacatttgtgtcacatctgaaacataacagatctgtcaggaacaaaagaatgggagtttaaaaaaaattaataggatgtcaaataaaggagctttaaaaggtatttgtcaccagcctaatttgagaaattctcaggtaagggtgtgcattccattttcctatgtaagtagaaatcaagcaggctaaaaaactcaaatcaaagtttgcctgtggcttttgaggatgcactttggaaagaggtaaggaaagatgcaattgcacctcagcagcttcttagagagtttagctggcaaggcatagtagggaacaaaccaagtaagggtgagctcaagttcccatcccaggtttgctaactagttctatgtcttggaggttgcctagtcattctggactttgatttttctcgtctgtaaaataacagtggtcattaaaaccaaatttatattcacataattccatgaggacttctgaattaagatgatagttactagcggggctggattcacaatcctcattgaaatacttacaaaaacacccattgtgatacaaaattccaactgcaaaagaatttaggaatgttatccatagcctgccagaccctaaaggaaatttatgctcagagttaagatatgcccttaggcacagaagcagaaaaaggatacttaaagtaggatatgtttctggagaggttatgggatccagggatccagagctgggctgaggggtttaatgctgacttcacctctcagaagctgtgtgaccttggaaagttatttaacatttttgtgcctccgtttcatgatctgtaaaatgtaataatagaaggctgtggggctctatgacctacccatgaagcacttagaaacatgcttggtgcacaggaagcactgataaacattttggcctcatatcagagacatgaggcctttgccaagtagaggaacagtcagctccattctcaactttcctttgaatttttaatcttctttgttttcttggaggcgtggggaactcagggctttaaaaaccaagcaagggattttaaactcgatgtggtagaaaatgggaggtcagccaagcatggtgcacacctgtaatcccagaactttggtaggccaaggtgggaggatcatttgaggtcaggagtgaggtcaggagttgggaccaggctggccaacgtggtgaatcctagtctctactaaaaataaaaaaattagctaggcatggtggcgggcacctgtaatcccagatcctcgggaggctgaggccagagaattacttgaacccgggcggcagatgttgcagtaatctgagatcatgccactgcaccccagcctgggtgacagagtgagattctgtctcagaaaaataatgaataaaatacttagaaataaatatattgaaggaggaacaagactggtatactgcaaactacaaaatattactgaaagaaattaaagaagacctaaataaatggacagacatcccatgttcctggattagaagacttgatttattaagatggaatactaccttaatttccagattttatgtaatacctatcaaaatcacaaagtccatttttttgtaaaaatggaaaaattgactctaaaactgcaacagacccaaaatagccaaagcaatcttatagccttataaaagaaagacgaagttggaagtttcatacttcccagtttcaaaacatactacaagactatagtaatcaagatagtaatggcataggatagacctatagaccaatggaaaataattgaaaatccagaaataaactcattcagttatgatctattaattttcagtgagtgtgccaagaccattcaatggagaagttaatatagtcttttaaacaaatggcatagcaacaactgggtatccacaggcagaagaataaagtgggacctatacctcacactatatgcaaaaattaacacaaaaggggtcaaagatctaaatgtaaaagctaaaactgcaaaatgcttagaagaaaatataggagtaagtctttatgacctttgatttggcaatagtttcttggacatgacacaaaaagcataaactacaagaagaacagattaaattggacttcataaaaatttaaaaaatatttgttctttgaaggacactatccaaaaagtgaaaaaaacaacctacaaaatgagagagcatgtttgcaaatcatatgtctgataagggtctaatattcagtattaaaaagccttttataactcaaccaaaaaagacaacccaattttttaaacgggcagaagacttaaacatttctccaaaaagatataaaagtggttaataaacttatgcaaagaggctcaacagctctagtcatcagagaaatgcaaatcaaaaccacaatgagatattttacacctactagaatagctgtaataaaaaagactgatgataataacaagaattggtaagaataaggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccgcacttaatcggttatgttatctatagattacagacattgtatagaaaagcactgtgaaaatccctatccttttttgttccaatctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagaaattccactcttacagtatatacccaagataaataaaaatatatgtccatatgaaaacgtgtacacagatgtttatagcagcattattggtaatacccaaaaggtgaaaataacccaaatttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagccgcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcaaaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagggagtgtttcatcccttatctgcaactccataaggcagacacccccagagcagccattttagaggctcctcctgggaatgcattcttttcccagggttgttaattattaatattccttactggggaaagaattcagcaatatttctcttacctgttttcagtaataagagaaacatggctctgttccacccagcccacaggcagccagactttaaggttatctcccttgttccctgaaaattgctgttatcctgttcttaaggtgcccagatttcatattgttcaaacacacatgctttagaaaaaatttgtgcagttaacggaatcatcacagggtcctgaggcgacatacatcctcagcttacaaagatgatgggattaagagattaaagacagacataggaaattattaagagtactgattggggaagtgataaatgtccatgaaatcttcataatttatgttcttctgccaaggcttcagccagtccctccgtttggggtctctgacttcctgcaacaagagtctatttatataaaatatccagaaaaggcatgtctacagaaataatgagtagatcagtggtggcttagggttggtgggttgatgggtggagttgtaggggagggtaggataactaaaatacaaagtttctttttgatgccatgaacatgttctaaaattgactgtagtgatggctgtacatgtctgtgaatatgctaaaaaaaaaaccactgaatcgtacactttaaatggatgagttgtatagtatgttgtgtctcatttttttaaaataaatagttaaaagacaactaaatttgcactggccaactttttaatctaaggagccatgagtattagaggtgaaaattacacacacacacacacacacacacacacacacacacaattagtgatacggaagtaaaaccaggaagttctaagctaaatagagaaagatatagggatttttgtttgtttgtttaataagagtgctggttgatattgagaaaaagacaacaaaggtcaagtgataaacagtaagtatttacaaatcaaagttgtaaacaaaatgcaagcgtgtaaaacaagcaaacaaacaaataaaaataacctgtcctgagctgggaaatgaatctaggatgcagatcaaaagcattcagcaagttaatgtggccaactcctagacctgtactcggtgaatatttgaattcaaaatattaaatggagaataaaaatgacctaaaacaatgctgtaagaaatacaagtataaaataaggctaggctgaagcttctctagaaaatgtaagaggaatgtcaaaggaattttgacaggacacatttgttccaaaaattctacatatagttaaattgccaataatttgtgaaggcaactgaaatattttttgactctttgcgtacataagcatttattgatttaatttttttaaatacttagaaacaaaaattagcttctttaaagataattttaaacccttagtaactaaaatatgagcaaatttggtttactgttaaaatatatttaaaacagaattgtaaaagattattgtatatattattacaaaatggaatgcaaatgtcaaaactaattattaaaaaaatgacaaaactagctattaatatagtattgctaaaattatgttttaaagttagaaaaatgagatgagatagagatgatgatggaaataaaggcatgaaaattgcctgatcttatacaaggaggaatcaagaactactaaatttttctagacaataatacttagaaaatacatctatagaatggctggtaacaactaactagagttaaaaatagaatggaaagtttacactacagaaaataagcatacaaaatatagtccacataccaaaagatggatcataaaacatataattatgatagaagcatgtaaaaaacataatgcaagactatagcatcttatgttatataactaaacataaatgagctaaatgatcctataaaatggcaaagattttcagacttgttcaaatgccaaaatcaaactctgatatctttaaaagagaaaaagggaagaaaaaaagtatagcttcaaagaaaaattttaaactattatgttagataagttaattttatattcatagttgacacaataaagctataattttttatggacaaatattataactgaaatatagaaagcaaaactaattagaattacactagaataaatctggactaagggtaatacgtgaaatattcccactatcactgtttttagcttttacaggccaaatagatcaaaagataagaaaattgaggatataatcaggttgatttagtgtatttttactaaactttgtaacaacgattacaaaaaaaaaaatcaatggccaaaaccatcaaatctcaatacatataacaaagtataagctgtataacctacattttaaaaattaaatacaatgtaatagaggcaaaagtaaatattccagaacatcaaaaaaattttgttaagtatcctataactactaggtcaagatggaaatcaaacttagaatatgaaatattttaaaattaaagaatatttgagaatgacatataaaaatatcatgtcttgaggccaatgctatagagacaaattcagagcctttaatgctattattaaatacaacagaattataataagtaaaattaagtattaaaagaattctttttttaaaaaaaagcaggatgaaaagtgtcagttaatgaattagcaagaggatatttagtgaattgttaaattcaagaaataattccttgaaaaaataaacttatgacaatataactgaaaaaacacaaataaaattagaaataaggagaataaaatgtcagatacataggagaattaacagtattattccagatactctctttaataccaatcactggacgtgaataagaatcgctactgtttttaggcaaaaagcaaagtagtaatcatctatgaagagacagaggagagtattaggaaaaaaggaaaattccatgttccttaacatgtaaataggccatttaatgtcattttttccagtaaaattgttgtttgacatatgtgtaattgcagatttgaattggactttttaaaacttgataaaattatgctaaatttcccctggaaagagttgtacaaaattgtcctctcatgtagtatagtaaattttaaaggtttcctaaccaaatattgtagacaatgtgaaaaattagaagatcaaccagaatggatttatgagaaccatagcttagtagttataagaccttaatacaaaagttggcaaatctggctcttgggccaaatcttgctctgccatccattacttttttaaaataaggttttgttgggacccagccatgtccatttgtttatgtattgtctggggctgctttggtgctaacaaactcagagttaagtagttgtgacagagactatgtggccctcaaaggctgaaaatatttaccatctggctctttacaagacagtttgctgatccattccttagtataacaaggaaagcattgcataccacagggaagggattttactcaatgaatgatttgggggaaactggctctctgataaaaatttttcaacaatatggtaatgattaaacaatggttctttgacatgactcatattgtacagacatgaatattgtgctttcagataatatttaatggcatggtaataattatataatactaaaatgttttttaaaagtaggatccccaaaacaccatgaatcacaattcatgttaaaaatgcatacctgcaaaactattggctagggaaattaactttttctgtatttaaaatttaattttaagagtacccacttttaaatattgaatctttatggtactgggttttaagttttaatattacttttaattggctttttcatactaatgattccttttaatgttttcaattatcatatgtttataaaatgtagagatcatttttattattaaactttataatgtacactgtttcataatataacaaatcatgcacttattactttttgaattattttttaaatataaatcttcaatgtttaatggaaagttatcagaaaatgatatcctgtttattattatggtcactcatttatttctaccataaagtattacaaaaagtacataatgctctgatttggggacttccagagggaaaaataatgcatacctgaactgatagacgtatttatgtgaaagtaactgtaagtagtacacaaaatttctacttagtagttaattcttggttttagaatttggggtttttttcctataattttattttatatattttctgctgtgaaaatacatttattttaaatttctgtaaaaaagaaagtaaatgttactaaatagttaaaggcaaaaaatgtagccacaaacaacttcacaaaaatatagcaaactgtttaatctcaagatgcttgatagttctcatgttcagcatgcactttttatgcataaaaactgaattcactatataaaatatgtatttacatcattatatacagattaaaaactgatatgcttcaaaactatcataaacacaattaaagggcctcctaggaaaaatgacaatcggcatttgccataatgtatgagatggctcagtatgacgagagtgtggattggtaaaattgtttcttggagatatcatgacaatatgtatcaagaaattttaaaatgtccctatttgttaaaaaaaaaaaaaacccagtacatttgcctcaatataataagttgctacttgttcaaagatttatgtacaataatttttattacaggattaatcattgctataacaaaaattttttaaagctaaatagccaaaaatttagtgataaatcgattctggaacatccacagactggagtctcataaagtcctatggaggctctgcaaatcatgacacctaaggaaataataaaatactctggataaaatattaactgaaaagggaaaaaataaccaacctataaaatgagataattctgtatttatccatccatttagaaggaaagacaccaaaatattaaccatgcttatccttggtgttggaaacataggccatttatattttcttctttatatgttttctttttatttttatatgtttcttctttatatgtcttcttttatatgtttctgtgctttccaaattttcatcaagaagtatgaataactgttctaataaaaacacagtcaattttttttaaacaaagggcactataggttatccattgcaatgataaatctagaaggtcaggctgggaggttattgttttgtcaaatctttgggatttgaccctaacatgttcccacttctgtgttgaaatcagttatacccaaatctttttgatcagtcactgacatttattgagcacctactaatcgttgggccttggtttagcctgaaattgtgtgaaagtcaaagagtgcatgacttttagaattgctcatcaacaggtacaatttcatagtcagtcccagggtttcacaggtgtctgaacaactctgggaccactcatatctctgagcataattgtctgctctctgagctggcactgcatcccagatgatggctctccttgatttttccatgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctgggttaacataaatgctaaaattgaagaaatgaaacattctaaaggcaggatcatgtaggtgagatcctttgcctcctaagcttttgtcctgccagtcttttctgtgccttaccatgatacctgtgctagaagtcttctgggaagctcttgtatagaacctccaactctggcagggttagtcttcagggatgcttcaggcagagaccttctcaatatctatccttgcgtcacatgggcattgagtataagacagctgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtgagggatgaaaatgattggatttttttttccctaccccaggcctgcctggcctgatgtgacagcagtggtctgtcctgagtctagcaggacatacctccatgtacccgactgacaccactgctagctcctctgcctcgggacggccatgtgccctctgtctccgtgtgagcagttgaaatggaggctcttgagtggagtgtaagaaatagggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatctaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccaattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcacgcttctcagatgtatcgtacactagcaaaaggggcctctgcttttctctgctctttctcttaacactgttataatatgctttttctttatttttccagattaggtaggccctgcaaacctaaagcttcattaaatcttgttttctaaaaaaaaaacgacaacactcccaacttgtgtgcattggaactcattagctcttgtagtagggttcccctttttctcctcagaaggaggtggctcctcactgctccttcaataacgatggttcagtgtgattggtatctgtttaggaaaggtccaaggctcaaggaaaatggacatcatgtgcacaacctcctaactcagaggacaagcaagtgaccggaaggccaaggatgctgtctgaccacagacattgcaatgcagacacataagattagaagcaaaacgcaggaggctggtaaggccaggacagtgggatgaaccaagcagggaagggacatgaatgaagcaggcctggtgggatacaatagagagtagtgtggactgtggctaaagggagcagctgctcagctcaagccaatagctgctttacgggaatctgggactctgccttctgactctaatttaaagaaggcaggaaccccgattttatataaaatcttattttaaaatattggcaacaaattcaatttaaaaataaaaacttgataaatgcagaagttgtctgtggggtagatgtagactgcaatgtgacatttcgagacttctattacagatcttttattagaaacaagatatcaagccaagtactatgccaatatattgtgctatttcttcttctaaaatgagtgcatgaggatggggtgttggacaaaaaaataatcaagggttgcgcttcaggaatcaactcagtgatgagctcactgtcctagccagcgtatccagaaacagtggcattaggaggaagctggtggctttcagaagaaggaggatcctctcgccaagtctgaagtgtctcattccagacttagaacttggccagatgtggtctattgtactcggaatactcagtgtggccagcggccttgccttcttgattgccttcctgtctaccacattccaaccataatggcctccaactgcttcctccaacaaaccaaacccagcttgtcaccactgtgcagctttggcctttatagtgttctctccctctgtttttttcagtgtcagcttcaatgttacctcctaggataattttactctgaccactgagggtaaaacaggtctccacacccattcaagctatttcatgttcttcaaatcaattatccttatgtgacactattcatttattcacttacctatttactcttaacccactagaatgaaagtttaaataacatgaaggcaaggtcttcatccttcttttttacaactgaatccgcagcatggggaatcatgcctggtgtccagtaagtgcccaataaatgtattgattaaaaacactagcaacaataaatacatacagagcttgtcaagtgctaagcaccgctctaatcgctttacaacctttacccatttactcatctctgcaaccctgtgacataggtactattactatcttcattttaaagatgagaaaactgaggcacagggaggttaaggttacccagccagtaaacagcagttctggaatccagatctaagccatctggcgcttgagtccatgtccagtattcacttttcagggtccaagtggagcttaagttggggctggggttgggagaaagtgatagctggatgaaaaagaaatctgaatactcatatgtgagtctcatccctaaaaacagagaggattcctttcacctggtgcgactgtgtgcatcaagatggtatcattctgaaaaatacatttctaagttgtgatcttcttagagacatatatccaaaaacctaattattccctctcatcctgtgtttctgctgttgatttgtgagataaagccacagggccatgtctgtaacatcctgatctgttccaggaatgcctgtgatgaatcaaaatattattcttttaacaaatgaagcagtaagcagcaggagttgggttatgaaggacaatattcagagaatgtttagacacatgattaaatgacaatttggggaggagcgctagaataaggagactgtcaacagctgaagagatttgtgtgtggatgttgtgatgttgcttatgagtgaatgcctgcaatgaaagtttacctctgtctcctgctgtttggaggagtctcactttctcaatttatattcatgacagccctttttgttccttctagttactgccttggcacttgactaatctgttttttcatacattaaggttggggtagaatgcaaagaaatcacaggtaacattttaccaaaacgtctggatccaactagatttgtggactcagaccctactcaagacctcattatgaagcttgttcatcctagacaatgaaaacaagacctggaataatttgataggcattttgattaatgatttgaaaagttaccatcaatgacttacttaaatatgtcttgcttcaacacttaaaccaagagtattcacattattgtccaaaagattcgatagtgtagctaaagtgcctcgcacagttctgggcccttagtaaatgatgctcctgatgataaatacaatgacagttaccagattcctgatacccttttatcctaggctagaatgcagaagacatgctgctcccatactattgcatccaaacatgccttagtcacactatcccaaacatttttgtgtgcatttcaaaggagatgagagatggcttgtttaaaaatttcaaatcaattcactttgaattctcatttgaatttccaagaactgactacctactgatgatatagatgcttgtgcaactcaaatccagatgggcccccacctccaccctgtggctaccatatgcccctttggctgtgttgaaaagaagttctccagtgctcaaaccgattttattccttggaaccagggctggtttcatgggtgttcagcctatgtggttgcacagggctgtactcagacacatctctgttgttttattttattttattttattttttgagacagggtctcattctgtcacccaggctggagtgcagtggcgctatatcatctcacagcaacctccacctcccaggctcaagcgattctcaggcctcagcctcccaagtagctgggattacaggtgcacaccaccacacccagctaatttttttatatttttagtagagacagggttttgccatgttgcccaggctggtctcaaactcctgggctcaagtgatctgcccacctcggccttctaaagtgctgggttacaagcggtagccaccgcacccagccccaagtctcttttgttttaatactctgctgtcaccattttgaaattcttaataattcatgaaaagtgaccttgcaaattatgtagccagtcctgctagaaacatactaaatatctgatatgtagaaacataaacaattttataaatttggaattttaaaaatgttatcagagtattttgtagttctgaaaaaaaaattctactgtaaatagtttaaccagctcttagaacagtcttctgagatctctgtaattaggatcagaactaaaataaaaatttctaatgagatgaattaccaaaatccatttgaaactggatttgcagaatatgaggcctatgactgagaatatggtcttcttaggaacacatcttgaggcttctatcattccttctggcttgctcaaggagtttgcccaaactgagcccaacatcactagcaggtagaaaggttagccttggtatcatcaggccataagaaagatcatgagccccaggaaaccaagggagcccttttccaaggaccattttatctccttgttggcttggaaagccatggcatggcatgaagcccagttaaccttaattcagacgaatgtcatttcacagtcatttttaaatccaaaattctgatttttaaataagatatgcttgcagttggacaatgttcaggcatacagaataacccaaattagtcttaaaaagctttatgttttttctttcctcaaatagaggtccttctgggattagcattatttaatgaatagatgagaccagtacataattagcatatcagttgtttagcacattcaggagaataactttcagcactttaagaaatatacgtgtgtaaaaactctgagttctgtttatggttttaatgtgttcagaaaagctctttatcatggattctccaaaggtcaagtttttgttcagcctatgtctgcattttcacaaattgagaatttgagaactccaaaatgaagaagattttctacataataaataaagatgctcagtgggaagacttcataatacccaggttatgactcattctaaatgcctacttttgccttttgcagtgaaagatggctccataatgttgggacccattttttaatcgttatttgtttttcggttgcaaaagtgaaaaaacaaatgcctgattgctagatgcacatcaagttataaaagaaaccaaagctgtgtttgatccctgggccagcccactgtcctctctctgccactaactcctccctccttccagccaggccttgcctccatgcctggttctctcccaaggacttcagtctcagtgacaggcctggcagtcatctttgacccactgtcctctccaccttctgctcatgctcaatcttttcccaagtcctattaattgtactgcccaataccactgagctccatccacctccctcgatcccaacaccagctctatcctagtccaagccatgacagcctcttactcagacctcctgccgccatcttgtacctctgaatcatcctccctacaacagccaaggcaatccccttaaagcatgaacctgattatgtcactctccaactaaaatccttcagtgcctcttcattattcttaagaaaaagtccaaaaccatgaaaatgtgtttcaaggttctgcaggtctaaccttggccatcctcctgcacccttgtctccccatggtccagcctcacagggtttctttgccttctttgagagcctcaggtcccccccaacaccaggttttgcatttgctttctttcttcttcagagaatgctcttcccccaagatctcccctctttatggctcaaattttagcataaaatgtacaactcccttggggaatttttctgggatccccaaaaccaggtcaagccctcacctatatttccttctagcctgccttgccttccttgcacttgaggaatttataatcaaacatttacttgtgtgatggttttataatgtgggtctccccttctaaggtgtgagcttctaggagtcttgctctccactgtggccccagtgcagcccagggcctcaaaggttggaggtgctctattggcacatcctccacccttgagtgaggaggagggaacaggataactcaccgcgctcatgagtgagtccaggacactgacggcaaatgctgtcccacaggcaaagggctgcgtgaggtacagttctgtatcagggtcatcatcatcgtcttggtccaaaaactgaacattagtatcgttcactagaaaaagcataaaataagaattagctctgaagaccacacacaggcattgaagccagagggagaccaggctactggtttagaaatactgaagtcattgagaaggaaacaaaagcatggaataagctgtagatggatctttgggtaaggggggcagtgggactcaatggactgttcctgtgtcactgtttaagtgtctgagacctggagagcaataagttcaagcaggcttgctccacggcaggccactggaggaccaatagactgtgctggccagtcctttggcatagctttaggatcatgacctaaaaacactttccagtgttttttggtaaccaagtcctttgagagatggacatatttcaatgatgagcagccatgctgggatagtcattttagccacaatgaaaagaaagcagcttattgggagtaaagagcgctggaaggggagcacagcaaaggcagatagcaaggaattcagccacaggcataacccgcagcctacccactgggattggcctgggtagttcccggggtcccaggccctaaatctaggtccacacccaataggccctgtttaatacacaggaaaccccaggtgggatggatgcctggctgtctcctgctgcttgctgacaaggacttgctctgaattttgagttgcatggggacgcccacgttctccctttcccatcctaaacagctcaatcttttatatgcttgcattcaagcagatgcagcattggatgctgtatttcatttccatctgaggattcctcaaggactcctcccgcatgtacgtgcaggctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttttaaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagcctgtgctgccaacttccttgggcaaagcatttcatcattctataccttagtttgtttctgtaaaatgggggagttacagcagctctctcatgaggctgtcaggaggctcatacgaatgggatggtgcccagtaagcctggcccagcatctggatcatgccatgacttgataaataccagctgctgtcatgatctcccttctgacattaaatacctgtccacccattatagcatgaaaatacccagcttccctctgcctctcttggaaacactgaaggtcttgctcaggggtctttcaagaggtagcttttcctcacctcccttcacttgtccaaagggatgttgtaggccactgtttagtctttctgttttgtgaatcagaaaatgtaaactggagaccacatatggaagaatgcagttttagttacttgtaatagccaccaatggtgtgtgtggcaatgctccgaaaagcacagcatctgttacctcttatcaggaagatggggaagggttggtaccagatatggaggtgaagtgactccaagtagggggaggggactcccgattgccagtgagctagacatctggggtcataggaaaagcgctccaagagaccagccagggtccagtgaataccttgtataccgttctgaaatacccagtctcagaaggagagcaagcaatgctactcaaggcctatttcacagaacagtaattatgtgggtgctaagaggtacccacgtaatcaccccaaagcatatgtggtcaaatacaattggaatagtcaggtgaaacagctgtaacacagtcctttcttgtgagactctgaggagcctttgccatgctaacatcaattgagagtctccaagtagatgaaaagtggaatgtgctacacagctttgaaagcttgtgtggccttggtgccctctgtgtctcttaaaattcattatactggcctggcataatgcagaacacatctcagaacatgtagataaataagaagtatttgtgggggatgtgggaggtgaaatggtctgaggagggtggtatagtggctagagaaataggtttcaaggcagaagacaagggtggtgtgagcacctgaaagattctctgaacacaaggaagaaatctggtgtgggacaaaggcttcaggagagtcaatgatgctaatcaaataccagaattgttgccttaggtttggggcaccaagcttttccttttctcgtctactaatgacaaattaagatatcctagttagtcagcggcacgtgaattccaaatagaaaatgaaattcccggcagtgaggattctgaaatgctgctgtaggtttgtgagatggagatgtttggattaattttccaaccagaggcgtggaccacatgagccctgggtctcttattgccctccagttctgaggagagcaatccagaaacctagggcttttaaacaactacactaaacatgaaaaagatacccctcctatggttggaaacagaaaatagtgtgatactccctgacctgagtgaatttgtcctgataaatagctatacctacaataatgcactgctgagtggtggacaatttattccttggtttctagacatctcgcaagcaagattactgtgttgaaagcctgctcccttattttgaaatatatttttgggccaagaaaatggggtgttcatttcatttgtgagtcatgtgaaggcaggtgctcccacctctctatccacccctctgctgagcagcacttttgctgtctctatttagaagatcaatccccagttctgagacttgctgctgatgggtgcccttcatggagttattaaccaagtcacggggaagtggggaagaacctaacaaatgcagtcacgactggaggcctttatcgtccacctgagtccattgtgaatctcccagagaggattctgggctgggattgggggccagagtgcagggctgcacgtgggtggctgctaaccttatcctccgcacccttcttgaaatctgcctttagtaaaaaaagttctcctagggaccaggtgtttttatggcttcagaaccagagcttctgagaaatgccctagtaggggggaaaaaaaaaaaaggcaaataaagtcagaataaagaaaaataaacagctggagggaaagtgccatcttaggtttcttatcttaaaattttgatattctcctttgacttcctctaagagctgtgaagacatgtcattcaaactgacagtatgttggaagaggagtagaagggagaaggcgggagagcggggtgacaaaaaaaagtggggaaaaaaggctcaggccagagaaaatgaattagagcaaatatgctttggaaacaactgccaggtcagatgggtgtgatcaaaggtttactgatgctgtgtggggaaaaaatcattaagaaaggccagaacaagacagtcgattccaaccagagccacaaataaaacacattcaaagcagtgccatggggtagcctttctgttacagccggtgaaataaaaacaagctgatgatagttggaaacaccaacaacagaacaaaaggagatactgatgtgaaggaaaacagtgcttcttacccagttcagttatcattagaatgtgcgtcccactgtttttttcctgattgactgataccaaaggcaacttgcccggtttagctaattggatacagcatttaagggttggggaaagggagtggaggaaagtacagaaaaagaagagagtgagggaataacagaggaaacattctcaagtaaagggaccccggaccacaggtagtttgcatttgtcttgggggaagaggccactctacagttttgcacactcactaatggtaacagggagtgccatggccaggttagaagttagattctattgtccaaccaacatggccctcaaaaccccatcattttgggggccagaatggcatttgctgaaaatggcttttggctgagatattcaactacgatacgttaaatgtcaagttattacacattagcccagggcttctaccttgttcccaaaatgggtttggcttagatccgaggctttgtatatcagtggaggactcagattgtaggagctgtccagacagaatgctcaaaagaggttcttacagtaaaaatcaccagaaagaatccgtgaactaagcctttcctcctttcctctccattcccaattgaatgccccaatcgcaaatccatcatctcatgctcctttgaaaacagtgaccagcatgaaggaaactgtctattcatctcagaagaaagatagatcagttttcccttccggtaatctgccatatttctccccataccttcctcccagccccctcaaaacaaaccccatagcagctacaaagttgaaagggctaagaaataaaccaacctcctcatatcctgtatggtttgaaagacagaacaaaaactccccccaaagctgacattgacccctacctagttcagtgatgatggggatgttgaccccagttgtgatggatggttgacgtaacatcccgtgcactgggctgttatctggagaggatctatccattcctggaggtgtgaaccctagtgggaaggaaacagaggaggaagaaaaatcagagaagtagaaaatttggaaataatcagagtacactatatacatacaaccccaaaaatgtagcttatgcattattcacaggtcaacaattagtattcccgggataaactctgatgattaattctttagaaggacagggtaggaaaccattataaataatcgtaactcacttcatagttccctaaaaaatccagacttcataccaattatttattctgctcatagatcttggctcccatctctttccagggacacaggagaattatcccctgtgcccccttgaagttaggtatggccatgtgacacatgaaatgctctggcccatgaaaagtgagcagagcagtgcatatcactgctggttcaggtattggacagccatctctctcttcccaggccatggcaactgtgagaatacaggttactatggagatgaaggctagacaacagccctggacagttacccagacccacaaagcatactgagtgagtcaagaataaagctgtgttgctttaagccgctgagatttgtttgtttgtttgtttgttgttgttgttaccacaacataacctaacctggcctgactgttaccgtaaaccaatcaattgcttatcctcttgctggtgagtgacttaggcctcagttttcacagagttctggccaatgggaggtgtcaggaaatcttcctggggctttcaggaagtgtttccttgctcttaaaaagaaacacataggaagagattctcttttaatttactgagcacggttttatgtgcctgtagtgccaggaactgaggcaccagctgagggcataactaacttagtgatattggctcaagtgaatgacaggaagagctgtcctggagttcctggggcaagcagcctggagccatcccacctcaggatttctccctatgtgagattttatacacataaacacacacacacacacacacacacacacatacacaaatgtatttatacatatacatacacacaatataataagatgttcacatttttttctttctgtttaagctaaatggagaaggagtttacttgcatctaaatcctcctgactaatgtatatgccacctgcttatggctgatcccttgaacttcccagtgtgccaaacacagaccacataaggtatatgtggacacaggaaaattggaaagcagcctgcttggtctctgattttgcagtttgggcttctttgggtcccaggtccaagccaagtacatacctggatgaggttggaacaactgtaactttcagtttagtgagagtgagaaatatcccggctaggcagaatgtctgcctcgttaaggttttgcatggacacatatcaatattagaaacctatttacttcctacattcatctggtaaaaattaatttttctaacgaagcatacggcagctccacgcaagtggcaagacccagtgcaattacatttagatgataggcaagcattcacactcacttcggtttctccttttttccttcagcggaatgctacatgggcttaccaatgaattagggacttttaggaacaaagtcacttgctaaatttccaaggataaaactccaaatagattattatgtgaccagatatctgactcactttccagcaatgtgacaagattgtgttgagtctggcattttggctaggtgtgagtcaggaatgaaatacgggagctcaataattgcctgttgttttggaggtgcataatgcataaaatgccagagaaatataaaagggttttcttactttctgctctcccgtgtatacatttcttatcactgagtgccatactttcaaaaagaaagacaaagttttacttaatatccattccctgactgcacttaaattgattctttacattaatacactatgaaaagggtaagtcattttgattgacattgtagtgtccatcttttcaaactttcgaatatatgtttttcagccaaccacataaccaaaaacacgcatttttaaatgctagctgttttcttcttctaggatggtgaaggggaaaactaaactgttttcattagaagtttcattcaaaaacatgaaaaactggaagtgacagctgtgcagattcagtggatgtgacgtttttgaatttcttcaacttgacaagtaaacaccttaaatcggtaatgctatatgcataatacatggcctgtattttgacatccatcatcaaatgctgacttgagaaaatacgggtttgtacgtcaaggaatagcacccataaagcagggagaaatgcaggtcacacggtattaggaaaactgtatttcattacagaactcgcaacaagccacggcatccttttattttatcttatttaaagattccattttcagctgtgaaaagactcaattcctttgcatgaaaccttcatttggaaatgacatgcttgcttcataggcttctttcattttgctttcatattccattttccccttcagtcaccaggcctggttccattagcatctgcaactgacaaactatggtaggtgtccaaagacatctctctgttgaaggcccaactctcccctatgcatgactccccaaaaaagtgtgcttttattgctaagaaaacttcatgcctctttttgtttccctacttttctagtcacacatttttaaaagcaaaaggcaacaataacagcaaagttggcttcttctttttccctggtgtagagttatgttaaaggtgaacataatttattagcattgtttctttcttaggggtactgatatgggaaaattatggtcagaaacggcaggattgccccagattccttaaatggctttggagagaagagaaattcaagcaccttccataaaggaatgaggcaatccggcctttgatgccataggatggtgtccaccgcattcctcatagctgcatttgataaaggggcaggtctaaattgtggcccaatctctgaccatcttgctctccttcccattattgcttgcagccatgactatatcatgggtagcacctgaagtctctctacattaaacaacgccctagttctgcatgtgaacacactggcacatggaatatactccagagatctacagctagagaacagtgaaactgggaaacactcccttcattagttaaactaacacttgggaagttaattttagaaacaaccacttattttgccagaaaagatgactaagaatatcaccattagagacatggaatgagaagtcctcaatcaggaaaagactgaagtttaaatcatccacagccaaagctatcaccagatgggctcctgattctttagccatgtacccatagcactttgttgatcatggccatgggaggcaagttttgtgctaaaaatgacttccatatgtttgttggccatttgtatataacatcactaagtatcaggaaaatgcaaatcaaaacacaatgtgataccaccttattcctgcaagaacggccataatcaaaatatcaagaaacagtagatgttggcatggatgcggtgaacagagaacacctctacactgctggcggcaatgtaaactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatatacacacacacatatatatatcacatcacacacacacacacacacacacacacacatatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactacaaatatggggcagtgtatactgcttgggtgaaggatgcaccaaaatctcacagatcaccactaaagaacttactcatgcaaccaaacaccacctgtaccccaataccccaataacttctggaaacaataaaaataaaataaataacttccaaagaccacctgaactccttacactgtaagttttctccccactccaatcttcagtggctggtgtggcaggtttttgttacctattttattcattcagcatgagacataagtgcttgaccaactttatcctatgacagatattctcattctatatactgtataagaactttaggtcagagactggattttcatttctttgaacttcccagattatctacaaaatgcccagcacatagaaaagaaatagaatgaaattgttaacagcatgggctgtaaagtcaggtgtcctggattcaaattctggcacctccacctataagccatggcactataagcattgtgcagactctctcctagtctgcttcttcatcgataaaccacaaatacctcccacataggacaattgtaaggataaaataaaataatgtatttaaaacatttagtacaatatctggtatgaggcaagtgctaaaaaatgctggctaccaatattaatattttattaggtatacaataagtattcgtggatcacttccccttccctatggataaagaactgaagaagtatttagtagattcttaaaaaagatttttcacacacagaaaatcctagaatactaatgagaaggcaatgagcattgtgtgtgtgtgtgtgtgtgtgtgtgtgtgtgtgtgtgtatatatatatatatatatatatatatatatacacacaatattccttatgtgatcataaggaaagaaggactatggctcagacaagatatacacaagtaatggctggaaaagggttccaggacactgtaaacccaagtgcattggaaaatgagaaaggctcaatggcattgtttttatgagactcaaagcaaaggcaagaatactctagacctaaactggttaataattgagaatgaagaagagagggggaaggctgaactagaacccaaagaaaaaaaatagccaacacttactgagtgcttactatgtactgaattttgctcacgtaataacttcggttctcagaaccatcctatgtatatactactatttttcagaggaggaaactgaagcacagagaaggtaagcaacttgccccaggacatacatctaggaattagcagatctcagagtggaacccagataaacaagtcccagtgtctcctctaagccaccacgccatattgcttcttatgtgccaggctgggctaagggttttttcatgggccaccttgtttattcctcataacagtccctgtgtgtttagggactgttgatatttgcattttgtagaagaggaaaataagattcagagcagtggcataactggctcaagcatacccaattggtaagtgtccctgggagccgcagccaggcagtctgacctcagactcctgacacctgcaggctgtgccgcatccctgacttgggtgctggccttctccttctaggtactgtccctggcaggcaagtctgaggcctgagccagtcttactttttattgttttcacttttaaacaatagcagataacaactgggacccattgtagttatgcttaacttgctttggtatggcagcatgcacaactcagtacatataataaatgctttattacagtacttttccatgggggaaacacaaagtactttctaaatcttccctagttaaatccctgagcctttccagggagagagggagatggaaattcttatcaatcatctcccctagaatagatggagaaatgaaggtaagtgcttctcccaccccgatagacttaacataaaggaattggttcaaatggtgggccaaattatcttttattgtgtgcatataaatgatggttagaaatccatatgctacgttaaactagggaaataaattaggccgagtcatctaggtttgctgagacaggtattcaatatgaagttgtaaaagggaaagatcacctttaaaaatgatctataaagacatgttaaaatcaagagaaacatctcatattacatcatctatgagatgaattaaatttcctgttaatgccagggaaaaaaacctcaaaggcaaatgtcagatgaagtgcagatcaataaaaatattttgataagtaaatgcaacaatgctatttaacacatgattggcaactgctgaaacataaattatccaaatttcccattgctgcttatgggaaaattatgcagattagaacttgattaggcttatatcatgagactcaatttggacttttaatctattaagctccaataaatgaggcatctgaatagctcccctgagcaactacggtaatagccacagcagtcatttttgcagtatgtattccaacgaatgcttcagcagctgaagtaaagaaaattccatgtatagaagcacaattgctttctaacttgtaggggaagaaaatccacacacaccaggttgatttgggaaacaggtttttggaaatgactgcaagaaaaatccagccaaaggaaaaacctcagtttaaccttgtaatattttttcacagtagttttcagtggcttcctatgaagctagaatccagagtcaggaaggccaggcagctgaccatgtttactcaataaaaaaaagattatttaccaaggcagcagcttctcctgaaactccccaaaggccaccccaacagggtagaggtagcccccaacaaggtgctggaggtcagtgtcaaggagggaagcggggaaatgcccctgccaatttgtgactcccccgcacaaagcctaatgacagtgcttggaaactgtataaacagataattctgtgactcctgagccaaaccataaggtgtcttttgcctcttcagcaatcattctatgctagaaacacgagagttttcaaaatcctctaatcaattcctccattcttcaaatgaagaaactgaggcttagaatggagaagttattatatccaaggtcacagaaccagttagcagcagaaccaggatagttgatatctgctgttttctgttcctttttaactccttctatgcataagaaacccattccacagtgtttgttgggggtgcagggaagaaactccgcccccaccctggaaacagaagtggcaacatgaagccaggcatcctgacttcacagggccgctgatggtcctgcataatcctggccacatcatcagtttagagatgagtctgtcctcctcaatctagggcctgtccgtattctccccaggacattatgtaaaagatggtaaaggttctgtggttgcaaagtcaggagtctgcaggtgtggggctactggcaagcagttagcccaccatggggtgaatgaaaacagggcaaatgaaccaagaggtggagagaatgagatagagctctgtcattgttcaagttcctgcacacaaatgtgcctaaaaccagagacattccagttatatgtctctgtttttacttaagcctttttgcattggatttcacttgtgccaaaatgtcccaactagtacaacaactgagaaaaatctccattctcttcgcggtgaaatgattcatgctggcctgattttctactgaaacaaatgactgcatcttcatttaaggtttcctgcttgtctccagtgaccagggacaagacctggcttaatactctccttgtttctttctatttacagtaactaacagtgacatttttagcggtacatttttttagagactgtctttgattagcacctttgcaagttgactccacccactgaataaagtgccccatcctttttagagtttacattttgggtccaacccaaaccaaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctattcgggaggctgaggcaggaaaatggcctgaacccgggaggcagagcttgcagtgagctgagattgcaccactgcactccagcctgggcaacaaagcgagactccgtctcaaaaaaaaaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagctcatggtatcattgctttctccacaacatctcaacttctcagttttaccttatcttaattcatcttacaatttaaagataaggccagatgcagtggctcatgcctgtaatcccagtactttggaggccaatgtgagtggattgcttgagctcaggagttcaagacaagcctgagcaacatggtgaaacctcgtctctactaaaaacaaacaaacaaacaaacaaacacaaaaaaattagctgggcatggtagggtgtgcctgtattcccagctacttgggaggctgacgtgggaggattgcttgagccagggaggcagaggttgcagtgagccaagattgtgccattgtactccagcctgggtgaaaaggtgagaccctgtctcaaaaaataaaatataatgagacatacttgcttggccagtgtggatcaaattacttataattttacctccactttggcctaagcaattgtacttctaaaaatatgtgtacagccataatttccttacattaaaaatttggctgccagggtcttcattcataggtattaagtaacaacattccactgaaaacaacatgaatgtccaattttagggaaattggttaagtatgcatccactaaaaataatgcagaaaaacatttcacgacagaaaaatggtcatgataaaatgtttgtgaaaaaccacaggtaacatactgacatgtatgatccatttttttgagggtaaaagtatttatatctatggaaataagacaaatatgtcaactttcttatgtctgagcagtaaaattacagggaatgtgcattttctttttggtttctataattgctaaattttctaaaataaacacattttatttatgtaatgaaaaaaattttttaaattataaattgatgttaaagaccctgaaatctcgaaacctcatgtgatctctatgggttgagagcagctgatgaacatgatggatggacacagctggttcatctgtaagggtctgacaggtctttgaacatccacttgatttggcagttaaggagactgaagttctgagatggaagtgatcaggccaaggttacaaagcaaaggggctttaaaagaacagggcccagagagagttttcaggcttcctagttctctgttatttcagcctcccaccatcttgtaagagctactcaatctcagagcagaggccatttacataaagcacacatgggcagtgaagagcccaagaaacccacaatgccccatgcacataggggaagggaggagcagtcagagctggtttccaacacagagggaaagtggcacctgctgatgcccatccctgctcccaccagccttacccacttcagaaacgctgttccccctcttccctcccaacccagctcctgtcgtttctttacctcttccaggacgtctgccttgaataacttctcacatttagttactttatgaagatgttttcctctgcctttttttccatcccctttattcgttattttaaaatgtatgaattattactaaatatatacaaattactacatattaatgtttaaatgttgttaagcatctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggatactaataaaacacacagacatcccccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaataccaaatgccaaatgggccccagttgtttggtttagtatgaattgatggccagcacagcagaaaccagaactccaaaatcacgagcaaagtataacatccatatcttaagcacacagaaaattaagtagctgtaaaagatgggtttgccaagtgatccaaggccttgccatgaaattcaggaaagcagaatcgcatcaacaactttcagccagctatctctgaatggttctagagacaagacgcctggcccaagatagcaccaaggttccaaacagttgatggttctttaaaagaaagaatctttttttcttaagtgttgaagtgtttcctgtacatacgtttatgctggcagatgaataggaaactgggatcttggatcttggggtcaggcattcccacatacatacacacacgaatcttcactagatgagggtttgatgctggtttgactctgagcatctctctgtacagcgtggtcaataacttttgaccactacctgaaataagccataccatttgtggtctagaacttgaacactgtggctagactgaatgagtttgggtcctgcctctttctgtttctaatttgtgatctggggcaatttatttaaattttgtgtctcagtttcctcatctgcaaattggaagaggaagatgtcatgaagattgaatgagttaataataataatacagggaaactgcttacaacagcacctggcacagagcatgtacttcatcagtactaacttactattatttatcaacaacagggttgtaagctgacagagaaaacaaaacacatgggttttagtcccaggtcaactcctacctctctgtgagaatgtagaaggattcaatgtcttatccaaactcagttctcccatccataaaatgaggttgtagcaatgtcccaaatccctttagattaccgtgcatcatacataatattgaaaccacgataattctgtgttcagctactcaatattcaggaatgtctgtggagtcattcatggggttgttcttttaaggaagtggaacacaggagccctctcttccagaatcctatcacattgtcggtatcaacaaacatatcaacatttcatacaagagatgcgcaccaaatacattaaaccacaacaaccatgtagcttgcacatcacaactccaggtacacatcatatcctctctcaggagtagcccctaaggcatgatcctccctccaggagccctgcatcctttccatttgctaacagtcaaatcattcatttgctgctatgcgatcacagtcgtggcaatggctgtggcccttggtgtcttcatctgtaaaataggaatgactctaaggccctctcagctttgagatttatgtctctttcatgaccccaaattttaaacgtgatctccaacaaaataagctagcaaagggaatccagaggatctccttacagactccttcacaagctctagtgtacatccagatttttttgattcagttttatacctttgcccagaggataaaacttcacttctcaaaccaaggagaaggaagtactttctccaaagttgctctaatggctgagaaggccataaataaccatttattaaacaaacactatgggctaaaggaagagaaaccaccgcaattaggcccctgaggcctgcaggcacagtacataacgatgggactctcataatccaggcaatatataaccagttgttccattttcttgaagttatcttcataatcaagatgctatctcgggcattgtgggctttaaaactatttttaattttaatttaaagagtaattaaagaaagacaatggatatgcaggataataaagtaagcgattagcagcatgcaaatgacataggcttaatgataatatggttctagtctccaaacagcttgtcgagagaaagccctttctacatgtggttgttcagctaatgtgtctcaacccacaattacaacattgctgacaccattaaccagtgaaacaacaccacttcgcgaaatccttgttgtctcattaaaaaggaaagggtcaggtaatttaccaacgttgtatgtctagttttgttgttggtaattagcaaacattacccagcatagactcccactgggaactggaggaactttgtgaaatattaaagaagaaagcctttatatttcactggaaaattgaaaagaggtgcagtaatattctccctgtcatctttttgcatttaggaaaaggaaaatgcaacttggaactctttaatttcaggagaaatattcaaaatgcattgggaagtcactacccacattaagaccctggatcaccattgtatactggcaaatagaatctgcatccctgtttacaaaagggagttggagatgggaggacgggaaaattgcaaactttatctttattgctcttacttatgttatttgaattaatctccttgaaacagaagaaaggagatataaaattttctttttgaaatgctacgggacttaaataagcaccagaattatttattcagaaaaatacacacacacacacacacacacgaacacgcgcgcgcacacacacacacacacacacgcacatacacacacatatttagacctaaagagagaagaaatatattccagggaagagacttcctgcctccatgcttcctaatagaatcttccccacattggaactcagaccccgcccccaacactggccaatgcttggtgtgttgtcagggagtagaatggtatcttattctttaaatggaacttttggaacataaaacacattccaataaatgtgagcagaaaattatgaattcattaaactactttggtatcttgtgctatatataatatttatattccgactactgtaaaatatgctttaatatctttaggcaactataaggacttaaatatttataaaatggctaaagataaagtatggccctcttattcctacatacagatgatgtaaggcatgcaatcaaagacaataacactctctgcccatttgtcatcttaaaggagccgatcaacgcgccatccctcgtgtgccatctacataagagttgttgccgacacaggcaactccagaggagtttgcgccttaaaaactacctagagtgctatacttcatagaaaacagggctttctgaaaatggagacaaaacaataaatttgcaggcaaaacagctccaagaggggcttcaaagtactgctgtatttatctctgggacatgagggaacaggaagcattttgatttaatatttcataagatagagacaattgcttccttgcatggtatatacttaatgctcacagaaatgagttttttttaaaaaagtttcaatatcttaaatgcaaataaataaataaataaggagacacacctgcataataggaagggcttcctttggaaatatggaatagacccatataatcccaataaagagaaagccaccacgaatttataatcacctaggggcctgttaaaagtagttttatagattaagtgtgaaacctcaaccctgatgttattattatttaccttccttgcttgcctttaggcccatggcctgattgattttcaaaattcttccatttcctatgctgattaggtattcaaagaattgtttgtgcccacctgccttgacctctcaaatggacaccccctggtttattttcccagctcccactagctccctgctgggaaccatgtggaagtttgtgaatttctcatgtatcttgcattttcacaatgcccattatatgctttccaaatctcctagcaatcatgcctaggagaatgatttattctataaataaatttccaagataaatttctatggaaatgtaagctttagtaaatcagctgcctgatacaaggatcagagatggtttccttgagtaagtaaggggctaggctggtgtttctcaacttgggctgcacgttggaatcaccaatgcatgcctgcatcaatgtctaatttaattgctctggagtatggcctgagcatttcaagaatgttaaaagttccccaggtgagtgcaatgtgcagctaaggttgaaaaacagtgggctagttcagaattaaatccacccatttaagggcaactaatctttgacaaggatgtcaagaacacacaataggtaaaggacagtctattcaatgaataatgatgttcagaaaacaatatttacatgcaaaagaataaatctgaacacttctcttacagcatatacaaaaatcaaatggattaaagacttgaatgtaaaatctgaaaccgtaaaactcctaggagaaaaaataggggaaaagctctttgacattggtctgggcgatgatttcttggatatgacaccaaaagcacaggcaacaaaagcaaaaattaaaaagcgggactacatcaaactaaaaatctgcacagcaaagaaaacaatcaacaaagtgagaagccaatctactgaacgggagaaaatattttaaaaccacctagccaataaagggttaatatcccatctatataaagaactcatatactcagtagcaagaaaataaataacctgattaagaaatgggcaaaggaacctaatagacatctttataaagaagatatacaaatggccaacaagtagatatgaaaaggtgctcaatatcactaatcatcagaaaaatgcaaatcacaataagatatcacctcatacctgttaagattgctattattgaaaagacaagtgataacaagtgttggtgaggttggagagaaaagtgaacccttgtacactgctggtgggaatgtaaattggtacagccctatagaagacagtatgaagtttctataaaaaattaaaaatagaaccaccacatgatttagcaatcccacttctgggtatatatccaacagaaatgaaatcagtatctcaaagagacatctgcacctccatgtttattggagcactattcacaatagccaagatatagaaaccactggtgtccattgacagatgagtagataaagaaaatatggtctgtgttgtgtatgtacctgcacatatatataatggaatattattcagccataaaaaagaaagaaattctgtcattcaacaacatagatgaactggagaacatcatgctaagtgaaataagccagttatagaaggacaaatactgtatgatctcacttatacatggaatctaaaaagttgaactcatagaagcagaaagtagaacagtggtggccagggactgtggtgagggtcagggggaatggggagatgttggtcaaaggatacaaacttgccattataggatgaataaattctggggctgtaatgtaaagtgtggtgactatagttgatagtgctgtgtagtacacttgaagtttgcaaaaagaatagatcttaagtgtcctcatgacacacacccgggcacacacacacacaatagtaactatgggagatgatggatgtgtttattaacttgattttggtaataatttcacaatgtatatgtatatcaaatcatcatgttgtaaaccttgaatatatacaacttttacttgtcagttgtatttcaataaacctggaggggaagaaaatcattagggtagacaaaactcttaaatttgtatataaatatttatgtgtctatgaagaggtaggaggagggtcacagagaagattcattattagctatttaaaggggtaggtacaagacccctttcccagttgagaactaatatgctataggttttctggctgagacccaaaattactgttttaagaaaaaaaaaaaaaagaggcaaaggagggaggccaagtgccatctgttgactaggtggagtagcatgggtcctgctctggaagggtgtcacttcaccaacatcagggctcctaccacaaccaaaccccagaggttggaagtgtatgaggttttctgtcagcgagctgtcccaatctctgcttcagagagcagctgcgttgcatggcgccatgctagcctgtctatggaggggaagcgccccatgctcactgttcatctgccctagtccttcctcaactcctctgtaggcttttgttagtctaccttacctggtctgctcaccttccaaaggtgtgttggtttctatcatcatctattttctatgcatatttacagacaaacagatcaacagtaattctggctgctaggtacaagtggataatcctaacttatgatttgttaatctgggagtaggaggggatgaaataaaatagtaaaattgtaataataataacaaaaatagctaacattgcttgatttctcccatcctaggtaggaagtgctttaacagccattcattcagggttgccatgtatggttgtgaaggttgggcactacacagtagctaatctaagtgggtaccactcatatcaataggcattgtatatttgcatatttatgacaatattttttcccagcagatgacagaaaagtgtattgttcaaacatattagtagattatcaccatttttttcagcagatgaaaataaggtgtcttgagaaaagagtgactttttctggcttacttaaaggtactgtatggacaatagaaagtcctgtatctcattgaattctcatagtcatttgataagccaggtgcatttagtattcttagtgagaaaattgagataaaaagaggtaaagtaattttcccaggcctagtaagtggcagatctgggcttcaaacccaagctgtcattccagacccatgtgtgccatgactgaacttgactgcaaagtgctatttctacagcctttgatgtttaataacctttctgcagccattatgtctttgtattcatacactgatccctcggtgttttggggtggggtcatttaatatatagatatatagatgaggaaatgaaatctggaatctttattatgtcaaattgctcatgatggacagaaccaggatttaaaagctgttccttaaccctccatgactgcatcattactctgacagccatgtttgtgattcactatcatgaactagagcaacaaaacacatcttccaagttcctcctgctccagtctaccgctgagaggaatgttcatttctacatggccagggaagctctcaggaagcattcacagctccctggagcagaaagcagagatattttctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaacccttgtccagtgcccagttgtcaaatgaagggagactaaatcctggagggaaagtgtaggtttttaatacaggtatttggctgctttatctcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatctactcaggttaacagtgcacccacctacaagcatttcctttgacatagtgagccctttaagtaccttggttataccattagtacacaaatagccaggtgaccctctgtgaaaaacactcggcctttcctgtttctgtgccttctgttactcagcttcagccctttccacatgcctgtcggaacctttatttatattaatcacacttattttcaaattctggtccctttactctggagtctttcctgactaccacagcccaaagccacctctgccttctcataacacattgtgtggcagcatgcatgggacactgaaaacatctggtagaacatctctcctggagatctgtaacaagatgctcaaggactatcctgcttttctggaattcagaaaataattttcctccagaccattccatgaagtataattgaagcatttaaggactagccatatccttaaatgttcaataaatccagaactaaagtcatttataaatcagttggcttctttgcagtgccactttttctttctttctttctttctttttctttttgcttgtttgtttttggttttgtttttgagatgggatctcactctgttacccaggctggagggcaatggcgcaatctcggctcactgcaacctccacctcctgggttcatgtgattctcctgcctcagcttctggagtagctgggtctacagatgtgagccaccacaccaggcttatttttgtactttaatagagatggggtttcaccatgttagccaggctggtctcaaactcccaacctcaggtgatccacctgcttcggccccccagtgtgctgggattacaggcatgagccactgcatctggcctcagggccatttatttctttatttttttcttgagatggaatttcgctcttgttgcttttaagaaaagaagtaaagtttttaagactgcacatgagctattgcctatagagaataggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggataaggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaaaatgttatttaagtgtcttcacaaagaaagtaacagctaggtctcaaatattccactctcttccttacagctccgaagtcccatctatattcacaagaaaaacagaaaagaaagactccaacagtcatactgttcacagagacaggctaagcacagtgcttcacattgcccccagatttactcatttgtccagtggtagtagcaagaaagactgaagccaacagaatcctagtatctctcattgttggaacagctagggtcaaggggctcaaaaaatggggattcacagagacaagaaccgttgaaaacaaacttcagccccttaggtgcaaggaccagtttagaagtgaggctggcacaccttgagcactttcatccccttgagtgtttgtcctgggggtgcccccatgacccttgaaagtacatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctactccagtgtggtatttataaatctctaaacagttaagtataattgtctttctggtttttgggacggaagccaacagcagtttcagttacaatggaagaaaaatattttagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtggaagttgaagatggggtggtctgtccaattaatggaaaagccagatctgcagctgctcaccccaatgccgtccgctccccatctttgaacacaaagacagtgccgttcaggaaggacatgaatgcttccactaaaagactcatgaccccaatcctgacaaacaccatagctctccctctggagttacaatgcaaatcatataaaacacagatccctatgtaataaaaatcaagaacatgctggatatccttagttataaaggaccacagaactcatctctctaccaatctccctcccatcacaaagagcgtgtcagtaactctcctttagcaaagagacagtcagggataggaggctcgctgcatttgcaggctgtccatgctgttctggaaatatcttccttatgttgggctaaaatcctgttctccttaattattaaccattggccctggtttttgtccaatggagcagaagattaaatggccctttaagcctgctggctttgttctcttaaccacttggcaagtgacatgttgtccaggcactgccccattctggccgtcctctttacaacatttttctgtttgtttgtcaaatttctgcttcaaatcttcacagctcttgacacattccctcctatcccaacaaagatgaaacagtcactgctcaaaagaaatgatgcttttatcaccaaggtttatctagcctgtctttactgatcatttgaaaattaacatgcagaggtcctcaatgcattctgtcctgtggatttcatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattccctacttgaggctcttaacctttgttgaaatgtggagaaaggagggtgtccgcttatatgtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaacttttcctggattaaggacttcatttccacccttcagcttttcatgcccatctggattttccactaagtccccgtggaaataaaccatgactaaaacccaatcctcccaacactgctttctcctgcagcctgtccctccactctgccatcctctgacccccagaaggaaacacacatccatgcagactgttttgcatgtacagtgactccttctagaacctcccattctttttccagtccaaggtttcaggcttccatctggatagccacagttcctaaccagagtccttgcatcttcttcctttccactccaaacaatgcttcacagggctgccagatccatctccctaaagctcaggtccaatcccatcactctcttgctttgaaaccttctgtagctccccagtgcctagtgaattatttacagcttcctaactcataaacacataaaaaattatttacagcttcctaactcaagaaagaaaagaaattcctcaatgcccaacccacatttcaacttcatctctccctgctgccttatatgtaccctgtattggggccaaattgtacttgtccctgtccctctaacacatccccaggaatctttgccgtcacttccattcgctccgtctcaagccagctcactttgcctccacctgttatctttttcaagcatggaattaattactcttttcctataaatctttgatgactcccccaaatccaaacccttagcaagacaagtctacactctaggactgcaccatccaatatggtagccactggctatggatcactttaaatttttatatttgttaaaattaaattaaaaggaaaaatttaattcctaaatttcaagtgctccatagccacatgcattcaagtcatccacagatgccacctcttcttttttttttttttttttttttttttttgagatggagtcttgctctgtcgcccaggctggagtgcagtggcatgattttggctcaatgcaagctccgcctcctgggttcaaatgattctcctgccttagcctcccaagtagctgggactacaggggcgtgccaccaggccttgctaattttttgtatttttagtacagacggggtttcactgtgttagccaggatggtctcgatctcctgaccttgtgatccacctgccttggcctcccagagtgctgggattacaggcgtaagccaccgtgcctggccgatgccacctcttcttgaaagccttctcaattcctcaaaatacctaaaccaaggatccctttgtgttcctctatttctagcctcgtccttgtttccttggactgtcattgtttatggggatacctcctccactcacctgaatcctgcaagcatagtgagtggctgaatccaagcaacctttggtcacctttgtgttctgggcctttagagtgcctgatgcatggagaacagccatttattcctttttcttttccttaggagttacctttcatggaagggtaagcaggaagcaactacaagatcatcatttcaaaacaatatgaaagcagaatgggaaatgccatggcatgctccctcttttcaggtatgaactgaagcagctcagagagcggacattgcctccctctgctcaccctttcttccaagatcagactcagttctcatctttttgaaccacagggaaacagtctggcaagagccactgttgtaccagctgatttaaattgaaatgttttccccagataaatgcgtgctaaataatacaccagctctccagccaaagggaagtgacaggcactctgtaaataaaggcacttagttgctggtaaagagctgtaaagtggttctgagctgatgtttgctgaccagcaagaagcagcttcatctgctttatataattgtcactgcagttttgcctgctgtatattaaaactgcatctcatagacccaactgtcacatcggatataccatctggcttgggatatgccaccttttctgtaattgtttttgacaacaagccatcacatcttgggtcttttcagaaagtgtctggtccagaatccctaggctgggtcagttctgacaccatgtgggctagaaaagtgacatcaaaagggagtgtgaaaagagaacagaagagaaaaaagaggctttgttagtctaggagccctaataacatgcagtggcagctgtccaatgaaggctctactttctcaatgtgaatgcacatttttcatgctaaattatatcatcttaggacagctttccatagggttgcatgcatattctggcccaagagcatgacatttgtcctgagtccacatttctacccagtgaggttctagagacatggagacagttcttcagacaatgcagagcatgaggttccataaaggaccatagaatacataagagggaaagcaaggtgtcagtggccagaaatctgtgtagttatcactcagaggaagttagatttgttttccaaaatgataagagtaacatgaaatccccagcactttgggaggccaaggtgagtggatcacctgaggccaggagtttgagaccagcctggccaacatagtgaaactctgtctctactaaaaatacaaaaattagccgggtgtggcagcacgcacctgtaatcccagctacttgggaggctgaggcaggagaatcacttgaacccaggaggtggaggttgcagtgagctgatatcacaccattgcattccagcctgggcaacagagagagactctacctcgaaagaaagaaagaaagaaagagagaaagagagaaagaaaggaaggaaggaaggaaggaagaaagaaagaaagaaagaaagaaagaaagaaagagaaagaaagaaagaaaaagaaagaaagaaagagaaagaaagaaagaagggagggagggagggagggaagggaagggaagggaagggaagggaagggaagggagggaagggaaggaaggaaggaaggaagggagggagggagggaaggagggaaagaaaagaaaagaaaaaaaatggagagtaacatgaaatcctttttgttccccataatccctattcccttggagcttgatcatgccaaatgcccagatgaaggatgacaaaagtatctcaggccagtgggcactccagttagtcaaaagggtctcagatatagaaaagcagggaaactcagctcacagagtcagctcacaggctgggaggagcccaaggagtggagtgctgggtctgcagccagaggtgagctctggggaaggagcgatttctctgtgttgatggctcccactggaccactgcctttacaaggttagagtatcaccagagaacagtattcaaaaacaagagaggagcagacagacagacaagaaaacaatgggacataaagtcttggtgggcctagagctttgacactctctcttagggagcagaacagactgctggctagtgagagacagatgctcctctccactgctgaccaggggtctacgagaatcactgctgagcatagaaacacatcctttgccttcttctgtcatttgtgcggtcttagtccatttgggctcctgtaacaaacaccataatctgggtggctgatagacaacagatatttatttcccacagttctggagaacggaaagttcaaggtcaaggcgctggcatgttcagtctctggtgaggactttctcgcagtgtcctcacatgacagaagggacgaggggtctctctcaggcttcttttactttatttatttgtttgttggtttattttattttgttttagacagagtcttgctctgtcacccaggctggaatgcaatggtgccatctcggctcactgtaacctccacctcccgggttcaagtgattctcctgcctcagcctcccgagtagctgggattataggcacccgccaccatgcctggctaacttttttgtatttttagtagagattgggtttcgccatgttggccaagtggtctcaaactcctgacctcaggtgatccacccgccttagcctcccaaggcgtgagccaccatgcctggcctcaggcttcttttataaggacaccagtcccattcatgagggctccaccctcatgacctaaacacctctcaaaggccccaccacctaataccatcgccttgagggttaggatttcaatgtatgtatttggcagggagtaggtggagggtacaaaaacattcagaccataactgtgtgcatgtgtgtatacaaaagaaagagtgccctttttttctttggaggaaaaataagctccctttctctttcctccatatctcctgtcaaaacctatttttcttgcttatcctgtgctataaaagaataaagaaggcttttgggcaccggggagtggaagaattgttaccagtttggcctttatataggatctaagaggctgggatgaggtttaagagaactggaaggaacaactatatcagatgtgtatgtaactaaattatacactgacattctaatctgtggccctggaaaatcatgatcgagtttggaggaaacaggcatgttggggaaagggagtgttttcctgcctcctcctgctggcttctgtctgtacttaaagggagaatcattgctttcactgttttcctttccccttgatggttcactcctccccaggagaggaggagcatctaccaagggttggtcacatcctgttcatgtgaaggtttactgtgctttaaaagggcacatttgagttgcctggggatcttgttggaatgcagattctgacccagcaggtctgggatggcccatgaggttctgtaactctaacagcctcccccaacagacacccatactggggcagggcagagaggacacatattgaaagtcaagggcttaaaggcaggaaccaaatgccggcttgcctctttcaactcctagaaggtcagcttactgtcttctcacatcctttctcgcctgtgctacccgggcaggccgcacaggatgcgggctctacctcttcaggatgcagctgggagtaagctcagagcctctcctaggccttcacatgttgtgctgtcctgcgggcacagctgagcaggtggataccaagatttagatttgggtgtggcagggaggacggtggcatggagaggtcaaaattaggcttcaggctgtatcagggtgatgtcagaaggacagaagccatttcacatgcaccaccaaaggggaaggttctcttaagcttgaccagaagctgctgtgaatctcaagatcctcagagaagccccagcccctctctcagtctgtagcagtgaagacactggctcccagaaagctcatctgatagaagatttgaacctgggtctgccagggtctggctgcagttgcctccaaagaatcaaagcctatctttctcctccactttccaaatctcaccccagtgcccatctcccaccagctgactctagcccagagccatgcagggaagaggattccaggaactattgttcctggcttttctgcaatgctaagcaaatgttagaaggcagtggtggtgatgtcaagttgacaaaaaataatgtagctcacaggtccaggatgcatgattcagctgagcttctagaaagcctggcatgatggggaggaggtcagacacttgccaagctatcaataaggtgatgcttcatatcccagtagccatagctctcatgggctgtgctcctacacccttccatcctggactgatgggattctggtccccatcaggcagccaatgccaccctctggcagctcgtctgtaacaactatcctccaattcatggctagcctacacggaggtgtcactcaatggaaaatgctttgcatcctatcctgccagatcctgattacagaggtcattttttatgaaggttttgctgtgttgcctttctgagacccctagacatctttacttgtaaccacctgcccagggtcccaaagcaaatgacaggaaagactaggggcagagtaggaaggcagacgtgtgtcacttaaggctgctttgcctcctataggaaaatgtgtggtctgacaagtgtcaccatttgctaaatgacttttagtgtccatagagttgccactctccagagattaccatcccttggtcagcagagtcctagaggcggctctaacaatagcaaagcttcattcccatcccagctcaatggcaaaaacatatactggaaggaaacggtcagaattgtgcagccagcttcttttcagtgctctgacatttagctgatgacactggtcatgaagccactccttgggaaagctgagggggtggctatttaaaggcttgtttatcctctggaaaggcaacctagtctgtgtgtgggtgaccaggtctcaagcctgcattctggaatggaaagaagaggcagcagatgcccctttgaaagccatcatggtgaccgcaggtttcactgccaggcaggctgatgtgagcctctttgaattactgagtgaaggatatccctcttgccagcccctgtcccctgcaggcacagcaaagaagtattacaggctgtccttaccttgggaattagcctgcaagactccgatgctgtcatcaaactgcatagatttgatgttgagtgacgccaagatgcattccttgtcctgcagcgaagtatcatcaatattattctgattggctgacaggataacgcacatgtcacagaggttgatgttgacagcccttaaatcagcccgacttaatggcgtaccctttggcatagaggaaagaaaaaaaaacagagatggggggagaaagagacagagagagagagagaggagcaaaagtgagaggagagggaaagaggaaaacaaattaaagattgagtcggagctttgggaaattatttaacaagtatcttttttatgccttgacattaagctggcctaactacattcaagggaataggagctgtgtgctaatctaaagggtagtcggtgctgatggcagcattttaagcttgttctcaatactcaatcaagctattactaacaaacgcgggagaggaataatgccagggttctacatcttcttcctgcctggaaattgtcttgatttaagtaactgtcctgtggcaacctctggctttcagaatgtaacaagggggtgggtttcaaatgcctgtttatttaatagcgggtcacttctgtctcaggcaaaagacagcagttccaatgcagccaaggagaaatggccagtgagcacagagtgatgaggtgggcctggatgtgcggctcaatttggaggctatggatggagtggaattaatgtgtgcaatgcaaaagagatatggaaaggagttaagcttcagatcatataattttattgcatattttcagcaagaaaaaaatacacagggaaatgacctaattgtccaacaacataggaatggagaaatatacttttggacatgcacacagtgaaaatgtatgcaggaggtaaagaggcagagctggctctccatgcaggcattggtttagaagcctaagatagagggggaagtgaaaaaaaaagttctacagcagttaaaaaaaagtatagtttcatttatgtaaaaaaaaaaacccacaaaataaaattacatatatataaatgtatgtaaatttggaaggaaagcacaggaaaaatagccattacactaataatggtaattccctctgggaagggaaataggattcgtgggggtgaggggaaagtttgcttttcactttatatacttctatattgcttgaatattttataacaagaacatatttgtatattacaggtacatttaaaaaataaataagccagtaaacagattttttaacataaaaaataacaacaaaagacagtggaaaaatcccagatccaggaagtaacaacagagtccgggaatgcaagcatagggaaaatagaagggttaggttaggacagggccatggcctccacatgctctgtgtcttcaggtgaagccacagcaaaatcatcaggccaccccatgccatagctccccagtggccacgcggcatcattttggggctcctgtctggccaccagcttcattggtcctctagcttgaatctagcttcctctttgcctgtgtggtgacctgagttaccttcaactcactgattgtgtagaccaagggtttgccaactgtcacatatctgggaatgtcctcctctaatctccctttctggagaactggctttggaaagagacttggctgcagagatggagcctatctaccctcttttatgagtcactggtagtcatgattctattctcaggccctaaaatattgtgcaactatggaggaaggggcatttagcactgtggttgctgctgagacacaactagttccaagctctggagcagcgtctttttgagagaaggagaatgccctcttctcctgtgatctcttggtacaaaacaagtccaaccaacttcctgaatcattttgccagtgcataagcttcaattgcctgcatccatattcttttaattttcatcttgtagggaagccagccgtaattgtgatataagatgatccctgtgcagttgtacacacgtgatttcaaactacaagaaatacaaatgacatacatagaaatcgcttatgtttctctgggctggccctataggcagggtactgtttaaccaataaactctgtgaagacataggtgaaggcccattttgtgaaaatctattgtgcttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcgcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatgacagaaagataaccatggaatcatataatcaaatcgaccatatttctggaatgagcaaagcatatatatgcttatgctctcctctgtgtatgactgtttgtctataggtgactattttcaactgcctgtgctcactaaggcagtgggtttttggcccagcatccaaaagataactgtccgatctttttctcactcctttaaatatttattgagtccctattgtgtcaggcattatgtaaaggcacatggtggcatctaatgagtaacatgtactgcttgtggatagattcttgtgtgttctttaatgaattatattacttggctctttttccccccatttctgaggttttggaagctgataacagaaataatacattttagctttgtaagtgggggaaaacccagacttcttaacatgtagagaaatccatgttcctcagttgtttcttgttttgtttttgtttttgtttgaggcaggctcttgttctgttgcccaggctggagtgcagtggtgctttcacagcccactgcagcctccacctctcaggctcaagtgatcctcccaactcagcctctcaagtagctggaactacaagcacacgccaccacatcaggctaatttttttaactttttgtagagaagaggtctcaccatgttgcccaggctgctcatgaactcctgagcttaagtggtcctcccgcctcagcatcccaaaatgcagggattacagggattagccactgcacctggcccctgtttctcagtttcagggatgtgaacttacaagaaaaatatttggaggataagtgagatttgcatgaatttgtgatgtggagaattacatcaaatgttgaaatgcataattctctacaatgttttgagagtttgtggactatgcattcattatgattaggaagtagttaattacatgactcctaaatcccatatcctcacactaaattgtggagtcccagactgttttttcagactgaagtcctaatgttttgcagtcaagaatatcatgcacacatgcacacacggacacacacacaaacacaaccatgaacacgttgctggacttctaaatgaacaggggttggggctgagctgcagaaggagttggccttctgtacagcagaaataaagaactctgttatttgcatttatttagttaaaaacagaaggtggcacagatcaatgtttcttcaagcattaaaaatgccataagtataatgctataaatagttctgtaagcaaatccttactataaacatcataatataacaatgctctaggttttgtataggcaggagtgagagtgtttagacgctgatatggttaatatacttgatacaagctaaacttcatccctgatgagggactgaacttggctgcaaattccttttaataaggtctcccagggtttggattttccttgacagagcataggggaagtgctgagtcctcaggcccatacccagatgaagaagcacaggcatgatcaaagctacaactattatatccatccgggattttcttttgtgaatgaaaagaagaaaaggcatcaataatgtgaccttggacttacaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcacgtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttagaattctagacttatcagtgagatgtccgtgcatcagcaggtggaacatgctacctaaagccaggagtggaaaactacgacccacaggccaaatctggcccactacattcttttgtatgttcagtgagctaaaaattgtttttgtgcttcaaaatggttgaaaaaaaatcaaaagaagacaatgtcataatctgtgaaaattacataaagttcaaattcccataaagttgtattggaatgcagccatgctcatacgtttaggtattgcctatgggtgcttttatgctacaacagcagagctaatcagtagcaacagagatcttataccctgaaaaacctaaatttttcattatatgacttattacagaaaaagtttgctgacccctgtccaatgctgccttggactttccagggacatttctggaggggcctgttttgcttaaatcattcagagaaaagatctccccaaataatcattacaaggggctagagagagattagtaagagcaacaggccagtgtcttcctccaactccaaacctctatctacaaaggagacaaatgaaagaacacagtcactctattagaggagaaccccaacttcccaggaaatacaaatgtttagtcactgctggccctttgattcactgagctagtgaagccaggaggccagccgtggacctttctctgcctctccttctggttcaatgcctcccattcctgtccacccactgcatgcctggatggccccatgtggcttacaatgctttgggggaggcatattaatgtccactgtacatatcaaactctgcttgatttaatctctagaattgaccactgcattgattgtataaatgccaatgttgcaattcacaacaatgtcagggttattacagtaacccccaaggagaggaagaaactagctttcactctctgatcattagaataaagcaggggctgtcaccattattggtttccctctgcaatagtccagggaaaccggagacataagctgtaagaaatgccttagaaactgtgaccaaggaagacccactggggagctcacatcacatatccccacttcctgcagaagacctggagttagttatctgggccgcacggaagtgcaagtgcctgggtgccaccaggagacagccaaccagtctataaagcactgttatgtgatggggctcctaattatttgtaattggccaggtcacctgggaggctagctcccttcaacaagccagaggaatataaactgggcccagggtggaagtgaattctagaatagggaggtggggaaggcacagttagttgagtggccgaggcacagatgctgaccccaggaacttcgatctgggatcaaaacacccatcctcagactggccacagctacatcacccagagaaccttatgaatatcctaattctagagcctcagccccggtgtgtctgattttgccgggtttaaagcacactagagagagaaactgatcatttctctatgtatctggaattcccatgcatccttccaggcccaacccaagcacaacctatgtgtgtatgacgggacttgcctggtcacttaaacacaccctagtccttctcccctacatttcaatagcattttgcacctcttaccacttagctttaaatacactgtttcatgggttacattttatatcttctctctaattaatccaggaaattacaattgggactatctcttatatcttcaaatccccaaagtagttagtttcccgtgcccagtgggtacacaacctcaaagcatcctcatgtagctggccctacctgtcattcttatctctagccgtgttactttagagagggcttcttggatcatactttccagacagcacctcccagtctctttctagcctacaatgctgctttacttttttcaaagcatcctataaatatctgaaatgttattaagtactcatttgtctacctagagataactcctcttcccccagccccaccctgctagaacacaaagagataactcctcttcccccagccccaccctgctagaacacaagctctgtgagagcagtcgttgtcagggattgcatctccagtaactagaatggtgtgtggcacatagtaggcctcctggagatgttttgttaaatgatgttatttttcataggatagaagtagtaactcacctccttaaacttttttatgctggcaggagatgttgattgaatatcagttggcatgcatactacaccaatatccaggcaagtcattaaaaccctaggtcccagatacggcatccagcctgtgacctgccacaagtggtaacatcaggctaaatttaggccaccagggcaaaagtgccatgaatacatcagaatgtacatatatggctgggtgcagtgactcacgcctgtaatcccagcactttgggaggccaaggttggcggatcatgagctcaagaaatcgagaccatcctggccaatatggtgaaaccctgtctctactaaaaatacaaaaaaataactgggtatggtggcgcgaacctatagtcccagctactcgggaggctgaggcaggagaatcgcttgaatctgggaggcagatgtttcagtgagctgatagggctctgcactccagcctggcgacagagcgagactctgtctcaaaaaaacaaaacaaaacaaaaagaatgtacatacgtgaagcagctttgcgagtagaacaatttgcactcctggtcagttggacaacagctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggagaaagaacccttccatctgactttcctgattattaatccatttctcatggattagcaagacaataaactgtaggaaagccagtgtaggcattaagacccaaagctgttaatagaacaagggcagagagtagaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgactttctctatctccttgggtgcacaccagtgaaacatcccagtagagtcgtacttcttcacattggagtccatgttgtcaatctgatcattgccaggaattaacaaggggtcatgcctgggaagaaaaggacaggaaaacctaagtggaaaatgtgataaattataaatggaaagtgccccctgaattacatctcagaggatgtgaaagatgcagaggaagtggttgtcactgaaggccattcttctgcttacagaatccatcctttgagagacaactgccccaaaccaccaccccacttctggaagtgcaggtgacctttgtcagggagcatttctgcctttcccccgctcctcttttcctaaatggtcttcctaacattttgtggattcagcctccctttttaaggctacctcactcctcttcctctcattttaccagctattcgatctccccagcgtgcacacacacacacacacacacacatacacacacacagacagacacaccaaagggttgctatgagcctcggcaatgaagaggaaggaataggaatagagcctcatgctgactgactggcatgaggatggaaagccaattactcgctccttctgactacaacttctgacgtgatgctcttcgcagtaaaagctttaacaggctgcactttaaatattttagcaatttgcccaatcagattttgctctccctggctgaagcctttaaagattcagcagcatgtcacttcagagcagactgactaccaaatgcccacatctggaatacatgatttcaatactaaacaacaccctctctccttgccttgacaactgtatatgcactaaccatccaatgatgctccccaccaccttcacctcccaactgctgcatatcttagatgagagcctcaagctcagatgcatcttaataaacttgtttcaaattctcagggcaacattcgccctctattgccttgtctattggtggaaaaggaagatgcttccataaaggcctcccgtctagtgggttggcagagcctcactgacaaccttaagaactgcaatggaatcaggcagttctaacaagcttatagcacaataaataagctcctgcaccttgaatcatagtcaatgtccatgcttttatctctgatagtgattcagcacctcgggtttgggaagtcattgttccttcctgcaaaactggccatataattaggacattgtcccagctatacttaaccactcttgaaatggagctatcttttctgagtaatattgtcaacacaagacagaaaatatacatcgggtcacattccataaattgtaaagtgattttaccttttgaaattctatatttcaacatcagagggtgacttttttcttttttctttttttttttttttagacagagtctcgctctgcagaggctgacttttatttactttttactatttgtccttctgaaatgtctccgatacttcccacttatatgtcaagagtacagagtgggacagcaatctcttccatggcccaaaaacctaggattaagcttttgaataactaccacgaccctccaatatgctccccactcccacataaggtgagaaaactttctcactgcctttatttatgcctgagaatttgcttttagactacaccaaatgacaaatactatgtgaagccaacttgcaaagttatcttcaacgaacatgctagactactataggaatatctgtcatatctgatcttaaaagaagaacaatcccactccgagtagcatctcagtgtctggattgttgagaggtcttgaggtatgtaaaccaccaggccatcttccaaatactgaacttagtcaaagatgttaagataaaaaggctgataagaactatttacagatcagggtgagagcacattttgagggatgtttttgtccttgaagagtctttaacagttgcatagatatctattaatattatctggaataggtaggtagacaaaagccatcatggagaagaggtttgagaaaatgaacaaaattaactctttccagcccatgaagaacatatttcagttgcaagaggatattagcagacttgccctgaagatatagagccaggttcaaattctcttgccctgtttactggttggagagaaagtattacctcaggatgacctgagacctgcccctagtgcatttaggatttaaaagatactcagaactatgttcccataatatcagcaagcaagcaaatgaaacagcaagctgacaaaaaacacttttagaaaatgtgtgccttggggaagaggagatacattttggtttggtatacttgattctttctgggaaggagtcagacgttgttaacagtggcctacaactttcatccagaaaagcaaataagcaagcctgatgatcgatcgcccttcaataaaaagaaaaaagacagctaatgtcaagcttcattaactggggtagtggtttccagaaaccaggcataatttcacactggagctcaagccatggtttgcaatggaacatccagaggcatccaggaagtcttagaggtatgccacactacactctactccccacacatctctcatcctggcctggaccatttaaatataaacaatccaggatttcccccaagagactgacctgaggaacatcaaaaacctcccggaacaaagacattaccctctctgaccagcatggtacctggaattctaactttggtttattgaatcagtaaagcaaccaattgaatcagtaaagcaatcaataagaatcccctattctgagcatggaatggaggctacagtaatgattaagataaagtccctagtcaaagagaggtccacaagatagcaggaaaaaaatatatatacaccaatagttcaatagttacagtaccttgtggcaagtgttacagcaaagtacaaggtgatacaagaataccaagaaaaaagctgttcatatcctggtatttgggtagcattaaggaaggttttgcaaagaaagtagcatttgggccgggcgtggtggctcaggcctgtaatcccagcactttgggaggccaaggtgggcggatcatgaggtcaggagatcgtgtccatcctggctaacacggtgaaaccccatctctattaaaaatacaaaaaaattagccaggcatggtggtgggtgcctgtagtcccagctactctactcgggaggctgaggcaggagaatggggtgaacccaggaggtggagcttgcagtgagccgagatcacgccactacattccagcctgggcaacagagcgagactctgtctcaaaaaaaaaaaaaaaaaaaaaaaaattagcatttgatctgaaccatgagaaatgaagaggaatctcagcatgttgcagtgttgatccactaatagccagtaggacccacccagagaattgaggcccaaatgaaaagggccaaataatggcacctaaaaccatggctgaagatgccccataccataccacctaacctaaggtacagaagactcagaccaggccttccagctgtctccagatgtgcaatgacagtcaagttgaagatggattaaactgattgagtatgactgattgacagcagactaagaatgatccatgagattaagagagaacaaaaatcatggttccaaaacaggaagattgttataaaaattgaaagtaattcaaaaatgaaatgagttgttgcccaagacagtgggttttctatcattgagccattccacaagagcaagggatacagtgagcatatgcatataaaggttgggcgagcctagaagatcctgaaggtttgaagcactgtgctgtcactggagaaagacacagctagaagaattttgaaagtactggaccattgttggatatcagaaggctggagagccctgagtaggtaaagaaaggttgctagagtgaagatgagaggtaagcagcgtgggagagggattaatttatggctccagtaagggccagcactgttacacactcactggatttcacagtctgggagtaagctgggaacacaattcgttccagcaacaatagagtctgtaactgtttctggccagacagtataaatttctttactatggctgttgctgtagtaatttcaagtgccttaggctggcctgtgctgcagagagatctctggaacaggtggagagtgtacagtcagttgtccacagggactaaatcaaagtttctaaagcttctattgctagaagaaagtccaagcatttgccattgagcacaccaatcaacactgctgtgatccagggagacccagaggaattgggccgtttgttgtatggaaaggaggatcatgagaaatctccctgaacaagggatcccaacatcttcagtttgcaaggtgatagagacccacttccaaagcctctcccacaactcctcaaagaccagttagttgaaatcaaggaccaggattagatattgtctttcacatcataatgacattacctaagtcttccactcacaaagtaattttcaatttccctaaaaggcaccataattaattcaaggctcacttgtcacttgcgacttagccaatgtacatgccctattttagggtaatagaaactctatgatgtgagatatatctgctgtttcatttttatgggctgaactgtgttctcccccaaatttttatgtgaagtcttaaccgccggtacctcagaatgtgactgtattttgaaatatggtctttaaagaagtaattaagttaaaattaggtcattggggtgagttctgatccaataggactggtgtccttacaagaagaggaaatttgggccaacttttccacaggagggaaaatcatgtgaagacagagggaaaagacagagatctgcaagccaagaagagaggcctgaaacagatccttccctcagtacccttgggaggaaccaaccctcccagactttcatctcagacttctagccaccagaactgtgagaagctctgttgtttaagacactgggtctgtgatacttgattacagcattcctagaaaattaacacaatagcccaccttgaagaaaaacaggcacaatatatcagatatcccttagctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccttcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttccttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccctgaatacagcatctgacctagagcatgtcctcaagaagtgttaactagtcttatggttatcatcctttatactttgcttaggacccactcatgtattactagctctgattatggtgaaaggaggcaggaaagggagagcagttcaataataaagatatagagctactgctattatttctactactgctactattaatactactactattgctgctactagtgctattaccattgttgttactatgatgaatagctgccatgagtccaacacttccaaatgttggtgcactaaaacttttacctacattttatgatttgctactcacaagaacacctgtaggtaatttctgttattatcgggctctgtgtatacatgggaaacaaaatagataagtaacatgctcaggtggcacagccagtgagaggagaggcaaagccttaacaaaaaggtctacttggctgaaggccagtgctgcagggtgcccacctcataccctcccactttaaggaggcagccatatcttgttcattctccatcaaaacaccccaagttgcagtgttctaagcagccaagaaagggaaaccagcatcgcaggcatttacaaaatgcaccacttatgtgaatgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaattacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagctttgacttcaacttaaagtcaccagctgcattagttccaacaagaatcagcctgtcctttgaagctttgaagtcaggcatttacatctgtttacagcatgatctactgaatattttaatcctgctgttgagacctactgctcagagaaaaagatttctttcaagatgttactgctcactgataacgcacccaattattcaagagctctgatggagatgtataagatgaatgttgtttccatacctgctagaacaactaccattctgtagcccatggatcaaggggtaattttgactttcaagacttattacttaagaaatatatttaataagctatcactgccatagtgattcctttgatgaatctgggcaaaataaattgaaaaacttctgaaaaagaatcgccattctagatgctaataagaacattcgtgattcatgggaggaggtgaaaatatcaacaggagtttggaagaagtgaattccaaccctcatggatgactttgagggctttaagacttcagtggaggaagtaacagcagatgtggtggaaaaagtaagagaaatagaattagaagtggagcctgaacatgtgactgaattgctgcaaactcatgatcaaacttgaacatatgaggagttgcttcttacgggttagcaaagaaagtggtctcttgagatggaagctactcctagtgaagattctgtgagcattgttgaaatgacaacaaaggatttagaatagtacataaacttagttgatgaagcagcagcagagtatgaaaggattgactccaattttgaaagaagttctactctgggtaaaatgctatccaacagcatcacatgctacagagaaatcttttgtcaaaggaagagtcagtcgatgcagcaatcttcattgttgtcttattttaagaaattgtcgcagccaccacaatcttcagctaccaccccccgatcagacagcagccaccaacactgaggcaagaccctctaccagaaagaagattaaaactcactgatgactcagatgattactagcatttttaggagtaaattattttaatgaaggtatgtacacacttaatagactacagaagagtgtaaacctaacttttatatgcactagaaaaaaaatgtgtgttacttgctttattgcgatattcactttgttgtggtggtctggaactgagcctgcaatatctctgaggtgtgcctgcaaaagatctttgttttgaggattcgcagagcaagaaatgccacttggcatcaattaatctcaggaagtgaactaaatgccctgctacaacaggaacagaaaaagctcgccttgaagacaacagcctaaagcaaaaccacaaatcccttttctagcaaacctgctgtgaggaagctgatatcatattttaaagtgcacaatttcccttacaggcaaagacagcaaatcccagttccttcggtggcactgggttcaacgctggacttcagaaatttacatgaaagtacaaaaaaccagccaaacacacaaaaatgttatgaaaaaggaaagttacaaaatggctagaaaattgcattcttttctctgcttgattttcgagacctcatgtcttatcacacgataaggccttttctgtcattatgagcatcccatccaaattaagggcatcctacagtggtctccctgggagatgagaggcttgattaaaaggaggtgaatttctcatccctccacagaccttttatccgagctgcaaatactgactttattgagcatctattatgtaaggcaccatgatggggctaacaagacatttctcagacttcacagtttggctcaagtgttcctcataaagccatcatcctgaacagccagagagactgaagttattttcccttcctgggaacttctagagatgctccttcggcaataataatttccatgtctgttttatccattagatggtgaactatttaggggcagggatctattttgctcttccatgtatttccagaatccagcagaggatgcaatcaaactaactaaaggaactgatgaatcatctctagtccccaaacactcttcaagcagtcaacagagactcagcaaacctttcgtggagatccaaaacgtgtgcagtgagaacccatttacctctgatatcttgcaacaatttgtttttgaacaatcagggttcttgcatcatttttcatttacagggactgcgtatgaattaggacacagagcatttgctataaaaagggcattgtgatgtgaaggacaaccctaaattatgtctctaaccagtcaaggctgcctgaagttcgcctggagccagctgctgtaactaatcagcagggaggactcatgtcagtggtcagacagatgttcttaattaagcaactatttggttctccagtgcaaagtctgaacacttcttagagatgggcccccatcacttcaagctcctctcactgttctgattcttcaaaagagtggttctcaaactgtggcccagaccagccgcatcagcatcacctggaagtttaacagaaatgcaaatttccaatccccaggccagatctgctgaattagactgtgtagggctgtggaccagcaagctatatcttaacaaagccctccaggtgattccgacacctgctaaagtataagaaccaccactataaagttttgcccagatggagaatctatatggcttcagtaaatcctacccaagttagcaattgtcaacaacacacagattataaggctgtagttctattcagcaaagccaggactacagctagacaagagggtgcctagggtgcaaaattgaaggaggcgcctcacattctgggtgcctactctgattctctgtgactctgtggaactcgaggcattgtgtcaacacttgattcttgatggggatttactgactagatgctgcactaatgactctctcttgctgacttctcttcccatgagctaatcagcaaataaatttaaacaagcaaattaaatactagtcctcgcaaagtgcaatacttacaattcagtgttctacccttctttaacaacatggtatctagtcactaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagacaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacctaagatgttatctagtgttaggcagccagcattctcagaagaaggaaatggttgcctttatgtttgggagacagcctgggagaaccaacacgttcatcagtcctacaggaggttgtacaagatgctcttgacacaagagggcaaggtcatgaccatctgctgagcatgaacttgtccagggacctgtgtggtccacccaagcctcagtaccatgacaccaactacttttttcttctccagtcctgggggaggcctgtcatatgctatcagtttgtgcattaagagatgaatttacttagctaagctgtccctgccttccttctttcttttgcccagtggaaggaattgtgagggtgacttggctcagtccattttgccattttctattactaaaatctttcatgctagcaggctctgatgtgagaagtcctaacaaaatgaccccacgaaaggtttgagtcaaaagagaggtgatgagacttaacaagtagatgagtttatttcacttaatgaccaggagatgcccaagaggataatctgttttcctcaaatcatattttgcctcccattcaggaaactaatgtctaatattttctgggtctcctgacatgaaactctcctcaaaatgttcaatttcttttttctgggtgttgtcaattatccttgccagcccagctgggtgctatctgtgtaaactgtccacctgatacatcctatgtaaatcctaactttcactgaagttttcattgaaagtttatagggttggtaaggcccccaaattaagaactcttgacctagctatttagagacaaagtctgtgctccccaggactttacaaatgaggaaagatgtagctatccttacaaggcaccaccccactaagtagggagaattgggccacgggtgcttgatgattttagaggaaaactaggatgattttagaggaaaactctaggtctcaggactgatgtcaggaattacgtgtgtccttgggaaaactatgtatcccagtcctggtctactattctacagcagaccctgaatggcttagcacacaaacggccttggcagaggctggggttgagtgggccttctatttcacacctctgtgcttatgtagtgtgtgtctcagaaatctcctgatggaggactcccaacccttctctctgctgccaccagtgattcccccaaaacacaagttaggttaccgcctcctcgaaaaccttcaggggttccctaatgcctatgacaagcaaaaccttcatgactgggtgccagaatactcttacattctccactccatctaggccactccaaagacccctggctatagccacacccaggcatttactgtggtctgagcactgtccctatgtcttccatcatcctaattagggaaaacttacctagatttaccagactttacatttctgtacctcaacatactcacctgtaaaatgggggcaagagtaataactacttatagagttgtagttaggactcagtgagttacaggcatccagtctcggtaaacctagacaagtaatattattagttgagcattctcctcatggtatggaactaggttcaataagacctcctcctaaaccaggctcagcctcccaaaccagaggtaatgacagctctttctattctcacagcccatgctagtggaacccccagcttgttcttacccaattctgtgtttttatgtgcttgtcttctcctctgctaaactataagcattttgaaggcagggatctaatctaatctattagactgtgtggaagttctttaagggatctaaagtcatttgggtgctagactttagattccttaaagaacttccatgacaacttgcacacagtaggctctcgctaaatatttgctggatgggagctaatctgagaaaaagattaaaagcaggcagccgaagtgcacagactttttggattccatgtgaggattcagtgtgagaacccaggtgtttactccataccacctacccattggagaaatctcatcaaccaaaaagcatttgtacgtgcaactatgtggaggtggctctggaataaactgaatgtgattgtaaccagggatcctgaatggagatttcaggaatccattaacctgcttcaactgtggtaaaaggggatcaagtgtactttttattttttcctagaaagacttcctagagagttttcattgaaggttcatagggttggtaaggcccccaaattaagaactcttgacttagctatttagagacaaactttgtgcccccctaggactttacaaatgaggaaagacgtggctatccttacaaggcaccaccccactaagtagggagaattgggcaacgggtgcttggtaattttagaggaaaactacgggaggctccttcaataattccacagtaagagaccgggaaggaagggaaataacaggcagagagagccggggacttggaagcctccatggctcacacctcctctgcgggtgtggagccaaatttatccatcattacacgtgtgtcctcagcctggggcccagacactcgccattcagctctatctggacatgagggttgttttctgttgaggtgactcaaaaacatactacctcaggatccagatatacaaaacaaggctgttcacctaatgatcgtgcagagttaagtgacacttaaacactagggtaagcctgatacaagaacaaagggaaggaaaagaccattagtgcagagtccccgttgcatctcctgctggcagatgatttggaaggagccttcacgcaggagtctgttttatttgcagaagccacagtggtaaattacagcccatcctagcccattctgggttctccagttcctcttggagctattcctgtcactgcccataggccactaaaacctgcccgcattcagaatgattgattctgctcaaactgcaagtcacaaactcatgtcgaaaaatccacttcaaataagtcattagcttcctttatggatttttcaggtcatgaggaataggacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagcacctgggacatagaaagacgtggtaagggaggagtgtctaagactttctcacttgtcatgggatggcccattccagctgggctgcgaagggagaccatggtgggctggtgggataagacatcccagcgacaggaactgaggccttagcagcagcccaaaggcaaccaacatgagaagcccgagttctgtagcttggcaagtttccactcaccacctgacccacgtttagcaattttgatgtaccatgaaacagacagctccagcccaggatgactgcctccctcagcccctctccagcaacgaatgaaagcaagatccactttgaaaattctcccccatcatgcaaactgacacaggcatgcttttcaaaaacccacagccaatctgttgatcattacttatttacaaaggccttcgggcagaaagtcctgtaaaaaccatacttgatacgatatacactagctttttctgcttgtggaaaaaaagtccccccaaggctacctcaaaccatcactttctattgcacataaaatgtagcgtgtaacactaaagtatttaatatatatggtataatatatctacaggaaaggcatttgtgtagaagtatgttaccctggatttggtaatttgatgttttgctgaaggctacgacttaaaaaagcctccacctcatacagaagacctgtcatcttggtacccaagagccaacagaataaagaagtacccttaagcagcaaaactttgacacagctttgaagcatatgaaaacagtataactcctcagaattattattactcaagatcaaagaaatgagccatactttacatagcaaacagggacagggaatttggctccaaaggtttcagatttttcagacttctctttatttatttatttgcttctctaaatttaggtgaaggaaagtggctgggcttttctctactttaaatgggaataactattagaattagataaggtgattacctaaaggtgagtaaataggaaatgaatgctagcatgacactggcatcataaaaacgaaaagcttggcagttggcacattttattcctcctcataaactgtaaacaagcatgcaaatcagccaaacccaaggaaggctgggtgaagtggaaggcagagaacttttaaggaaacatttaacaggaatagatggtgatatggaaaaggagttgggcagggtgagtcttccacggaaaacctgtgtcctcaaccacatgaagaaagactgcccttgcctattttccagaaaggtggatgtggagggccaggaacatgcaaatgttattgaatatggggagtggaaatcaccactattctatttcaaaaatcaaagccggtggccatgaaaagacaaaactaatgtcaagatggcaggcatttccagagcagaaaccacatagggtgagcagtgcaaatctgaaatcactcctgtttcatttgggtggtagagagtcaggatgtcggaggaaaaaaatgctgggattggcagatgaattgaagacaaaaaggggagataaaagacagataggccaagaagaagaaactgcagaacgctgttgaaatttgacttcacttgctatttaccagaggaagccatagtcaagaaagaagtgagggagaaagagagagaaggaggaagggagggagggagggggaagaagggaaggaaggaaggagggaaggaaggaaggaaggaaggaaggaagggaggaaaggagggaacatgtacatgcatgctgtatttcataattaatattgcttttagcctgagcagaactggattacttttgaactttgctttggcaagtccacagattattagactttttcttatcagtcaaaatcaattaacagaaatttgatttcaatcgacaggataaaaggaaggtaatcttcaggttcatttttgattgtgatgatacatctcacatatggccttaagtacagaaaacagtcctcggagggactccagcagaaagagactgccgcaggcaaactaaccacacgagtttctctgattggttaccgccatcattagtgccactgctgtttaggaactacacacagacaggacatggtgacagctaagactttaaagcctatgtatttttcaaacagcttttcaaactgtttttcatgacagaattttttcagctctatcattaactgctgacaagctgacagaataaatactccagcctttaagaagccatctaacgatctcgctcccctcccccaccccgggcttgctggggaggggagactctgggcctggcagggtgaggagagggcgaggggaggaagagaagggctaagagggaaaccgtgggcaaccagcccctctccttacctcatcagcttaggcgaggtgttgggtgagttccgcatgcctccattccgttgctttttttttggtgatagtgttgacggctgctcatcttcaactggaaatacaggcagctcatgagattatgaacagtttgagggcagactgtgcaatacaggcaaaatatcaaaggacacacactcaaggctcagtcactcactaggaattcatggctgtcttttaggacccaatgacaaagaccaaatgtgttagtcaaagaggccggcttagagaaggtgaaggcaacacctctttacactccagcctttgaacatacactttaaacagactaaaacagtttgtaaacaccctgccataagaaaaaaaaaaaaaaaaaagaaatcatgatttatctgtataccaaaaaaaatacttatcattattcttagagttaattttggttactttgctttgcccagtaatagactgcgttttgttgtaaccaaaatcagaaataaagttgtatttgaaatgtcagcataactgccagcctgctgcttctccagatgaaccaacttagctggttcctaacccctgcataccagagaaagagcgttgaaaagaggcaaggattcaaggccttgacagccaatgtttcaatcagatcggggcacattggtgcatgctggctcaataatccccagcccaactcagctcttatccctccaactgccaggagggagggcttgtggggctgtgccaacggggtcctttttcaacccatgaagacaggagcaccggggctggtgaggttggaggagagccccggaatgaaggaggaggttgccattgaatgaaatctctgatgatgcagcagcggggcagggatggagggcagcacaggggattggaaaccaaaagctgttttccaaatgtctaaaccacacagattgctaagcaatgtgaagcttcacttagaaacaccacagcacactctactgctcttgcccaaagacacccactaataagctttgcagatgtattagcctgcatcatgcttctttttaagagaactgcttgataattagcagatgcaaacccagcctgtcacccaggggcatcagcggcaaaattctagtcctcctctccccacccccacaattcaggctaaagctgtaatatcaagaaggaaaaataagatctttggattcttatagttgactgcaacacagactaggaggaaagcaccctgaaactcagaatgcacagcagttaccttaaagctaagaagagaaatattagcagtgatgacatcaaaagagacttgatatatgttaatggtgtaggagtcttagatgggggagaaagtgccatgtcagctacttggtattatccaggaagacccatattagagcatgcattatatggtacttccctgaaaacgctaaataaatttagtaggttatgatacatgcttccaaagctattttaataatccaactaccctccaaacctgcttcaaagtattacacattttacactctcctattctgctgtcagtttgggcttgtctaaaccctggctgatgcaggaaaagggaatgactgtggtgtaaggtgagagtgagaccagaagagatgaaggcaagaaagcacctgcaaacacccacagccgaccccctgtaccacctgcttcctctgacacccaccagggcccaagctcaggccgagactgtatcagtcatttagagctccaggcagagactatgtggctgggatgatatcgcatcttatcagaaatgagtatccaaagcaaatcacacagagactaaacagcacttaaaagattaaaggaaataaatacaagccacataaatggtattgaaaaaatcacttagagttgatatgcatctctcggcaagcaaacaggcactctgagcttgacctgaattcatcttcctttcacaggataggggaccaggcatctgaggcaataatggggtagaaaggcagcgagggtgtgtgggtgtgtgtgtgtgtgtgtgtgtgtaggtatgctttcgcactttccccatcttagaatgaagtagaaagtcttgcactaactagacgtataagacaaggtcatcttttaatatgggccacttgcaattggtgtattgtgttcagggtgacctagactggttgtgtagcatgctggagcaaataacacgtgtgtgtttgtgtgagtgcatgtgagtcactctagtcggggtgcaagttctgtttttctcatcttaaggttataattcagttagacttcttaaggttataatcccacatccaaaggtttttatctaacctagtctaccacggctagcatttttcaaggtcaccagatgctaccatggttgtgtccagttacacaatgaatctagatgagttaagacctgaacagaagtcatcctccctagcatgcctgtgggattattttgctgagcattggcttccctttttgcattgggcctataacaaataatcctctttggttaagtggccattatctttacaccttgttgctacactgatcttcagatgggagagttgcaagttaatacctgttagccagctcaagggagacacctcattctggtagtaaagttatgcctcttctatgcaaagaaactatttattttcattgcaactcagaaagatcatccatcgtaatcatactgcatttaaagtgggatttgttctccaaaatgaaacttgtgtttaaaggtttcctcctgcactcacagcctaaaaatgcagatctgttccctgaagagatgggggaaaatgtctccagcttaaatatatgaacgctgtgtaatggagaccattacatatggcttaggtccctcaagagaagcagtgataacttctttctcataagtaggatataaaccatatttaattatcagcctttatatggatcctatcaatttctgcataaagaaagcagatctaggaaaacttttagttaagctataaaatataattttcatttcatggcttctgtgactacatgagaggaataaaaatggaattaaaagggagacttaaatttactcactttcatgaaagacaaacgtgttgaagtagtgggccactacctcatgacgatgcaaatttacaagctcttatttaacctacattttggctaattacaatacacctccatctatggcattttcacttgccttcatgctgcggaagccacatgaagatatgatcctttaaagaaacctgacttctttagaacacaaacaagttcaggaatctaacgtggaattttataggagctgaactccatccagtctccaagtactcataaaattcaagggcttgtttttgcacatccctaagtataacacttaatgtgctgttgtaacttcccagcgctcccttgtctaataggcactgaatctaacagttttacagtttgggaagactcagtgctagaaaaatgtcaggcaagtctaatgaggcttcagatcccctggtttgcgctagagtttaatttaaagttacaatgatgttttaacatgtttgcttatacttgactaaagaggattcgttatttcaatgacataacctccagacaatgttctgagaattgatttaagatgtggtggtaattccaacagccttaatgcagagttgaacatctgtaacaacattttactcgacttttcatcagcattctgttttcaagcaaaagcaacgtcttccagaaacactggccagaactctgggcttacttcaaaatgattacatatttcactagatttttaaaaaaagaaatatcttcctttatcagccgcgccagactgcaaacactgtgtcagggtttaccaagcctctttatggtccttggagtgaaatggggcaatgattgcaactcccagccttccctaattcagtctaatgcctgcattagatggacctgatgctcagctctagcctggggcacattccctctgccctgtttccccagtgagatttaaggggatgatgccctttaagatttaaaggtgagtttattggctggagttaaaaaacagttcaaagcaaataaactcagaaacgtaataaaaggcaaacaactcataaacatgagtcaaccgctatctccattatgttattaatcaccacatctggagaaacccacatctgtacacacttagcaggtcattagtaatgtcatattcacactggagtcactcagaataagagtcatgcaaagtggtttgaacacaaaggcatctagctaacagggcttccgactgaagtcttgcacaagctgccagtttgggggtgaggtcgttttaattattattaatcgttttttacggttttcccttttggtattttgctgcccaacaagctaagtgcaagctgaaatccacagtagtgcatcgctcttcttcaactgagctcagcatggtaaagtagaatgttgagggctgcagggtagttattaaaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccatttttttccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaatgccgtgagtttgccactcctcagaaagacagatccacggcatttccttcggccgtcagcgacaccagtgaaaagtgggtgtttcaaatgttgttttactaaaatgaagggtatggagtgatggtaaaattcctggaattttacaacagtcgtgttgcaaaatgtaattcaccatgaacaaaactcccaagctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagacgggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcactaagaagtttgataagcactgcagtattcttcataaaaatcaactataaatctattttttgaaagatcgtggctaatattttctttttctgagacaaggggtctttgttgcccaggctggtgtgcagtggtgttatcttagttcactgcaacctctgacatcacggctaacattaatccacagattaggaaaagaagaaagatgctgccccttaaaagcaaccccaacgatcataatatctcaaacatatacacctctctaaaatcaaacaaccacattatcatatacattattctggcaggataatttcacaacttctagctaggaaataggaaacacatttacttggaaaacctaatgggtatcagtttttaaaaaatctatcgttatgcagaataagaatttcaaaaaatgtctaagtgacctgtactgccctaggacaggcatagggagtgcccaccccatggtaggctgccagggcagggaagggaggcttgttggagcttttgcatttctggcttttgtggagctaataggaaaatggggagggagactttaaggaacaataggttatgtagaagttaatcacagggtgtatttctggctctattcactgcctaggaaacctgaattgtgtaagtttgagtccatcaacacagagtaatgaaagaattcagctcctccataggagagagaaaaaaaatactatataaatatatgaacagaatccacatgacatggaatgcagtgttctctacaaaatactgcgggcctaatggatcctctagaatccaattgggtaaattagatgtgcccatgctacccatgccataggccctcaaccccaatctcaaactatgttctgtatgcatcctgagaggaactcagcatgtaccaaagccccccatatctagaatcgcagctcatatatcttcgctgtagacttgacctgttagaatcattgcccaacactccgccctgttcagtattcagtagaaaatccttttggaattttctggttgcctttagcccttttctttttccctggaatagactctctattacctcaagggcaaagaaaagtctcaagcaaagatcactaggtattagtttcttagagatgagacacagagatgaacgatggaattctaagaggaaatgcacaattgaaaagaaaaattcgagaacttccctgaatttttgctatggggtttggagaatgggaaggtactaggagatgggagataatttttactttacatccaactgggagggctggggaatgtatagaagtccaatacaaacagcccctcccaactttcctttccttctctccctactccctactcctgacaccaaaagccaactttcggctttgtggcaaaagttaaacctgactcctttaggttgccctagcacttgcagtccgcgtttgtgagggacaacttttagagtagggatgaaacctgccacatcctgggcaccaacagctgcttctttctcatctttctcaagttcaggggtcagcaaactgtagcctgccacctgtttttgtacatcacatgagctaagagtgtgtttacatttttaagtcattggggaaacaaaatctaagaataataatatttggtaacccactaaaaagatatgaaatttggtggctataaataaaattttatcagaccatagccacagttgttggtttaccagccatccctggctgcttccatctctaacgacaaagttgaggacttgccatagagaccatatgggttgcaaagactaagatattaactcgctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagttagattcatccacccagtactttggaaagcaaggcgaaccacatctaccgtgagcaattcctcgaagctgtcagcgtgtgctgccagtccaccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggatacatggtgtggcagtttcactgtgaatccagaatgatccagacggctgctgtctctttgttaacaggaagccaaactgatgagtttgtaatgcatttcttatcaaaggtagtttcagaaaagaaaatgtgccccatcagtttggctagaatttcacatacacaagattataggcttaatcagaatatctctgttattttcttgaggaaatagataattccacatccattccattaaatcattttatgccaatgaattatgtatttatgaatttataattatccttgatttttcttccccttttgcagtctacttaataaaatcatcagctggagcttacaaagcaatagtgcttaatagatacaagcatgctaatatattttttaagtgaatgctgatctttctgagctgtgtgtctaaaatcatcattgtgaataaaagaattgtaatttccaacccatacatttaacaaagacaaagtggactgtaatggaatttatggagcctgtaaaggaactctttttctaagacggtttataatcaaatagatttggatttactgtaggtcaaatcaggtcccccgatgtgtatcaagaaaaaaatgcctgtaagataccaaacactgctcctggcaccctggaagggctcacacccatggctacagctgctagtttcctggtgtcctcattgtttccacccctagtgaattcagtacttaaatgtcagctttgaaatcaatatttatactgtcttcacttaaaattatgacattctgttcatcctggattttttaaattttgattattttgaaaatattttattttgatagtttgaaaatattgcatgaaactatcatttatcttgattcctgaggttttgggtctcctcttaaatttggtgcccagggcaaaagcttctctcacctcgcccaatttccagccctgaacaccatttctcaaaggtgtttgaggtactggttctgccaccccacagaactggacaaggcaaatctaacacaagacttatttcttttgatcacttcatgctgtttgcatgagattgttaaggaaggcccttgcaacaaacacttcctcgtggatttacaaattgtcaggcatcccaaggagtggagaaaagatcatgctgcctcaggaatctgagatttgccacctgcccagagtgagaaacagaaaagagagctggggtcaggtctctcgtggactttatttcacatcccacatcaaatcctcctggttaacacaatgttgatttacatttccactttggggtgaaagtttttatttgcttacatattttgacaccaatgttactttctttttctttccccccacccccaaacaggttcaaatagccatgactggcagaagatgtcaatcacatttcatttccattttcactttgctgtttacattctttaaattaatgcttgccccaatgattgtgatatttaaagaccagcctagaatctaattgtgtatatgtgaaactgttttctaaaccataagatgttatataaatacaaaccactattattattaacattattactattggctcatccggaaataccatatcttccattgagccaatggtgtcaagagccccctagaattctaatatatattccagatgggtgcactgataatttctttcaaactcagataaaggtaaaatgcatgggtttttagtgcaagccaggtgcccgacgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgggcctttctggtcaatgcattggagaacaaggtgtggagtgcaacagaagggctggaagcggcttggggatgctctggcctcaccctcttttgcgtcatagctgcactcatacgcagaccctgacccaggacccaggtcggctgacttctaattcagatcatttgctgccagaattctgcctgtgagtgagaacagcatgaggatatgagcttcttgagtcagtccacctgcccaagtcccagctctgaccctctttagagctctgatctcagaccagttactccatacctcaatgtcctacgatctactgtgatccctactggaccaaggacaccaaatttcggagatgctttgggattatgtgacataaccagggggctgcaggctgacagcctgaggaccaactactgtccccagtgtgctgagcttggcaccaccctgctgatacacaggatttcacatgtgggacaatctttaagtctgaagattgtccatacaaatatggatttctaacttctaattaaaaatcttgtagaggactgagtcttcattccaaaagggtgccattctcctggggcaggagcttatcagctgctcaaatgccccactgctgcctactgtacccccatatatagggcagacaccccatgtttgcatttctggccctggaaccagtgacactcaagtgtaccatccccgaaataaagattttaaggcatgggatatccctccacaaatgcctactcacattgagtgggtagagaggttaagagttaaccacacaggtcttaaagccacattgttgggtctgaacctaggtatttggcaaattatctaacttcagttttctcaccaataaaatgagaattagagtacctatctaataggttgttgtgagaattgactgaaaatgtgaaaagcacttaaaagaattcctggtgagctctttctaaatgctacccatgattattgccttggctttgaagagtcagagcaatgagagttctctgctgctgggtccttctccacaccagtctgccacatttggacatggtgtaattcacatgggtccatactctctctccttccccaagcaattgagccgctaaccaacacttagaatggggtgagcattcccacccccacctgacccctagccttgcatctcattcaactgtcacctttgtcccttgtttcatatggccccaatgaagtgctcaagtcaaataattaggttttgccaaatgtcataaaaacaagaaaagccagaaaacgtttaaacggacctcaattggagaaggctggaaccattcagggcaagaacaaatgaaagacagatggggacagaggaaccccactgtttcctctaaattacaggaaattcacgccgtctgattgtgagggcctcttttctttcccttgaatttctgctgggaggtcatgggattgatcggcgtgtgcagacacatgggagacagaagaaggggcagaggcatggcggggtagagaggcagtgactccttcaccaggctctcccaccatgtcttcctttcacctgactacttgaccacccttgaagggacagcctaggctgcctcctccagggggccttcccagatgattatgacaagatcaattctctcctttctttaaaaaatcccctggcacttctgatctcatgccttgcattattataatttgtgttcaattctaatgtgttctactcccccagctaggcttataagctcctctgttggagttcacatatcactgagtctctcacaatgctgggccctgaaaagttcccaataaatagctccgagcagctacagaggcgatgttgcaaaggggagaagcacagcttagtgatcaggagccccggggttctaggcctgccttggatcaactgtgtggccttggcaagacacttccctttcctggggggatgagcattagttaagtatgagacccttctggctctgatttgtaatgactctgagtttaatgtcgggcatacctttttcttgttcttttctttaaaatctttttaaagatgcacaataagagagaaccacaagcctagccagagaaattagataattgcattaaatacgaatatacgaactcataagttacataaatgcaacagtacaaaagatgttgcatgagaatgtcaagggagggctacatgaaatgtcttagacaataagttaagtcctagagagagaattgttcaggaaaaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttgcaaaagtctatcagaaactgcctagctcgctcagcccactttcctttccaaggtaagaaacacacattcatgcatggaaataaagcagggaggcccttggcaactgtccagttccattgaagttctcatttttcttttttttctggagagcttattcaacaggaaaataaagttatctaatgcctcagaaaggggtcccgtgaaactcacaaggcctattcctcacagcccagccaggtaaatttaccctgatttcaggatggctatttcttgtcttcaactactccagctgatcccatcccctctacagagaactggaaggaaacccgtcagggtttgacttttacatgaaaactgactgcaatccatattttcaaaaaatcattttcaacaaaaccagtgctttaaaatagattcactgagaagaaaatgtttccccaatcctctcctccttgattttgttgaatcaataacatttcaagatgttctctgtgaaaatcacatgggtgagttaaataagaacatacattacattatctagatcctcaacttgcagcccttagcgcagtatgcctgagaaaagtttaaaaactcaaaagagagaaatcctattcaaagagtaaaatactgcctatgcttccaaagttctttacggcctgataggtagaaatttaataatgaagggctgggaatggtggctcacatttgtaatcccagcactttgggaggctgaggcaggtggatatcttgaggtcagttcaagatcagcctggccaatatggcaaaaccccgtctctaaaaatacaaaaattagctgggcatggtggcatatgcctgtagtcccagctacttggtaggctgaggcaggagaatcacttgaacctgggaggcagaggttgcagtgagctaagatcgcacaactgcactccagcctggatgacacagtgagacactgtttaaaaaaaaaaaaaaaggaagaaaatttaataatgaaaaacataaacaaataagtgagtcatcctgagacatatttcaattctccccttctgtaacctcaataaattcattttctcccacataagctaatgtttgcactaaatattctgtacaaaggaataccgcagaccataaaaaaaacagtaaaaagatatagctgtgtcttttttaaaaaacggttgaaaaattgggtatgtgtggacaaaataatttttaaaaatagttttgcttgcacatttgatttctctcttcatttatgatgccctagttgatgagctgatcaacttttctgtgaaaagtcttcctaaaaaacagaacaaaacttaacagaaactctgatcctgtttgtcaaaatgtagttctggccccgagagaaaggcaatattctttggatgacttggattctaaagcaactcttttattagtattattatttactttttttttttgagacggagtctcgctctgtcacccaggctcccaggctggaatgcagtggtgcaatcttggctcactgcaacctctacctcccagttcaagcaactctagtgtctcagcctccaaagtagctgagattataggcacctgactaatgtttgtatttttagtagagacggggtttcaccgtgttggccaggctggtctcaaactcctaacctcaagtgatctgcccgcctcagcctcccaaagttctggggttacagacgtgagccactgcacccagcctggattctagagtaactcttgatgaaagaacatcatactaaggtgatttttatataaaacattaattcagtatatcaatcagtcactttaataaaaatgcccctcattatcctgaggtgaatagaagcctatgggattaatttgtgtaaatagatattagattaaaatgggaacttgccacataacaataatcagatagcataggcaatccaatctcagtgctgaatccagtattgtgtgtgtagttaccttttaaaaacagtaacatgtatttaacttggacttgcttcaagtaagcactgcatcaggcaagttggatttcaaataaaccttagcaattgaggggcattgtcgtactggaagtatatctcttcaaacaacagcaacaacagttttagatatttattttagagaaataaaggagacaatctgcaagagaaaaggcagaaagtgaggaggaggagagtacctagaatccaggtagagggtttatttctagaaaagcagcgccacctgctggtggacctgcatgtcaggcccttctgcggcttgcaggccatctgtcttgcaatctatgcataaatacacagcagtatttctcagctgctgttatacgtaagaattgtattaccagtaggcagatttctaacacactggttgtagtttaataatcctatattacctgaagtatgggttatataaaaacctagaatgttaattgttgacaaaccaattctaatatgtaaagcactgtaagtcacccagtaaatacacaagtaaatcaaaagggatagctctttttgctctaacaacgtgttattaaaagccacaacttaatcacttacataaaaataatgttcatgaatttcgatgtactaagaaatcaggaaaatgcattataatcttactaacagagcttttccttcacttacaatttagaggaaactattttgcagaaaatatttttccctttctttaaaaaatgtacctaaaccaacatgccatttaggaaatttgctcctataacaaaacctagttacaaacaactaagattacatctataaaatgttatatttttaaaatagcaatagagaagttgtggaaaatatgtcactgatacagtgagcagagaaacactacctgtcatttttcaggaaaagatcacacaaacgcgatagcaaaggaacacaataaaaagcagaaacaggaatgtgataggtgactctgattgcatctgcaaaggaaactgtgaaataaattaacacccaagtacccaagaaaggcacattgtggcttcactggaagtgatcattatgcaacagagaaggttggtgattttgtaagaacagaaataaagtgtagcctgtgaaatctagtggtgataactaatgaccatactacttacaactctgatttgatctctaacataaaaaaataaaataaaaaagtactctaaagaatagatgtatgcaatagggattgtgtttctcacttgaaacaaataaacctcaaatgggatcaaagggccccggtaaatgaaaaatgacagttcctatgttgccctgatttgatctcaagcaaaactaccatgctgataacatagcaggggatgtgaggaaggcagtggagttcttggattgctatgaaaaggaggcgagtgtgtagcccattcagctgatgggaagcccattctaattccaaaaagttattgagatttaatctctaacaacaacaacaacaacaaaataactcatgcggcaaccaaaagggtatcctttaaaaacacacatacacaattttgttatttccaatacattctgtagaatctctttacattcaattcttccatctgtctaagctgggtaaggcacatgtgtgaagagaaccaaatgtcacaatgcttgctttgagaacgaagtgtctccagttatccagacagggagcttgactaggagggtctcaggcataggccatgggcatcccatctcccatctcagctggctaccactcactctggagagacagggtttccaggagcaattctggacagatgcaaagggtgaaggggaatctggtggggttcagggctgtcaagattcgagttgggggcttaccctgcctagatataactcctagtgttagcttgtgtattagtccagtgagataaggtctaggccattggctagggtctgaacaattaaaggtgcacaccctgccttaaatatccaaatttatttgggataaattcaaatcaataaggaaacataggtggatgaacagaagcaatgggtttgccatggcttcctaccccgactcaaatacccaatgacatatggaaggagaaaacatcagcacccccagatccactacagagcccaccatgtgctgtcagcagaaacaacggaacaaatgtgttaccttcagaagaagcagtgatcaatttgagatcaatctattcaagagttgtccagcagtcaaaggaattggctgttggctgttcagaaacaaaggttctgttcaagaaggtataaaggaacaagaaggaagaaaggaagatctctagccttgagacttttttttttttttttgcctctggttcagcttctcatgaaagacctttttccttgagatacatgcttaataaactatggaaacatattgtcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttccgggtgggctagttaagaaggcttcacagagatggcagtacttgagctgtaccttcacagcagaggttggccaactttttccctaaaaggccagatagtaaatattttgagctttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagttttaatctgctagaagcagagaggaaaagaatcacagtctcaggaaaaggttccagaaatgtgtaaagtaatgagaataagacgcttctagagaattgttagatgatggatgcttatgtggagaacggaactagggaaactggttgaggccaaactgcaaaggctttgaatgccattttaatagcagaaagttggaaattatcctcttaaaaaacaaggaaccatcaaaaggtctctctctttaaaatgggataacatgacaaagtctgtgctttagaatactaaagttggtggtggtttggtggcaagaggaactaattgaaaggttgaagggcaacaatggcagactagctgaagaagaaatgagcatgtgagcttggcagtgccactggcaatggtgagaaaaggttcgaaatgtaatctggaggccaaatcagaggacttggccatcggtaggaggaaagagagagtgttacagggtaaaactcagaatttcaaatgtgcatattgatactcattccactcatccctagacctatccacacatcaggtctgctgaaagaaagggatagtggtaaggcatgggtgaaaaacttgggcccagtcttggccttgctccaagcactcatctaattaattacaaaatcaacaagaaacagagcccagctactcataaagcaaggtaggaaaggtgatgatgtgaagtctcaacaccaactggacctcaaagatatggccagacatggtggtgcacgcctgtagtcttggctacttgggaggctgaggtgagaggattgcttgaacctaaaagttcaaggctgcagtgaactatgatcacaccactgcactccagcctgggtgacagaaggaggtcccatctcaaaaaacaacaataacaacagaaaaagatgagttgagatcaagaccatcatcaaaaaagaaattttgatggaatttgaaaggacaggaatgtcttctttccccatctgttctcctctttttgtgttccaactttccctccctctcccaaaaacacattgaatttgctgacgatctccagacctattttagggatggacaagccataaagaaggggtttcagggggatgaggaatgatgagacctgaagtcacagttttctaatgatcccaggacctaaggattctaacagctgggctaaaatctaagacacacatttattttcatccatcaaatctgtactattccaactaggaagcctcttttgcctggagatggtgtccccgtttggccctatatgcttcctgctacacgatttcattcctggagacctggcaataacaaaacaaggtgtaacaaatatgatgaggaggctctttggggaggtcaacagttagcattcattgtgggagggcagggccatttgtagagacactgcatatgaactggtctgggatagcttcagtagctgacaatgttctgattactaataacccccaaatcactggagcatagataataccaggaccccgggttagggagagggcctttttctgtgctttccttgaggaaaataaaagacaccttggaagaaaacaagctgacaataaagtagaaacctgtaagaatcttctgggctctttcggtgtgtccctgtgcgcccagttcctgccctagaagctgcgaactcacagacagaagactaacactgatatactacgaggtttctacacacataattgttcctcacaggacctaccacgatgttgggtaatagacatcagcattttagaaggatttataacagtaaggattgaagcaaaaaggacttttagcctttctcaatcagaagaaggaagataatcagagtctcagagtttaaaggaaacttagaaatatgaccttccaatttcctcattttacacacaaattttgcaaggcctactggatagtcaagatggaaatcaatgttctggggagatatagctgtctcttggtatttttgttggcttatttctgttgggacaattattccatgacctagaaattaaacaaattgactccatttaacttttatagtctgttatactaagctgttcaactctcagccactatctgtgggcttctctgcctgtagctgatatgacctcttataaggctagcttgatgacagtcagtcatttgaaaaaaaaaaaagcactagttatggttaaagtggcttatcattattatttccatcaatactatgggagatggcaagcttctgatctagcagtccactcatccgctatgtgatcttggtcaagttcatctctgtttctttgttaatttcatatgttaatgaaggatgataaaaataataattcaacatataccaggcaatctttatatatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataagacattactcttattatagccatgagcatctacttggtgaacatgtcaaagcatgacttcaccaggacttacttccaaagtttccagaaaattcacagatctcacccttgtatctgcctgctctgacgtttcctagaatttcaggctgtaattgccaacaagatctctcagttcactgcacagtgaggggaatggcatcagaatcccctaacatagagaggaggaaatacaggagatgtctgcctgtttcccatcttcatcttaatagaagatgtttgtgaaggagcagtgtttccagcaaccagccccttgcaaatttcacattcatgccctaacttccagaccctgtgacatgacctgagccccttcctccctgtcttcattcctagcatagttgcagcttttattttcacctagcatctctcttctctgcaggtcattgtgcatcccttctcagtaacatctgtttagggctttggttttgaagcatccctgctggatatgttctctcagttggatacgttacaggccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgcgggaggaatcatttgggtgctgctgttgcattcaagctgcctacctcgagtcagagtcaaattaccctgaccgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctatatgtggtagtaaccctgccactcctcattggaagcattggtggatttttgcctatgtggttttttctggtactttgtttccagatcttctttcccataatttatccttcacaaagaatatcaattgcacctgccatttgatcattttctagttccttcagtcatgtccttgttctttcttactacatttttccctcttactcttcttgtacatcccagttttttatgtttacatatatatactatatagtaagttgctgcttagaaagttttgggaagcttcatggatctagggcgatctggcttctagcacatcaccaattcctttaagggttgggaagcccttcatttattcattcttttactcatgaaatatttactgaactggaatccttcaggccatttcctattcaagtactcttgccaatataggaagcccagccaaggatgtcagcatgctacatttttgaccttggagggagggaaggcagcccctgggtcctttcttgactgagtgtgatccaacaggctccagcccagaaagctgacattggccaaaatgaagatcattttaatgcaagcagtcagctcccttcccagaagatagcccatgctctatggtgtgcagatgcccatctatgcactgtcgatacagctggtgcagtgccagctctagggctggagtctttctcacttcatttataagtctctcagtgcagtcgatcatccctaatgcagatctgcctcaaaagattccattttctatttgcatagggttttctctgcagctctaggaacatttggtgggactcatcttgcggtattgaaggggctagaatgaaaactttcagatttactagaaaaggctgggggagttttttcttgctgtttcccttgaatatgagagattagctccccctgaggatgaccaaatgagatggtctgagaagaaaggccacttttgttagtcctgctcatctgagctggacatcaaaagaatgtctcctcagaataaaaatctgtgggcatgtgtagcaatctccctccaaagcaggcactatctagctatttacagaaaggcctttgcaattccctctgagatttcaaatgcaagggtctgacaatgctggatttagctctgtccatttagattccctttgggaaaaaggtcagctggggaagcagaacccctgtaagcagatgtggcgatggagggtcccctgactatccaggtaattcaacaagctggtttgggagaaagccccagagagagaaggacaacacacagctggttggcttggtgcattttgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggttaagtgtttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctgtcaccttcaacacactcaagatgtaagatatatttgaactggggaagatgatgaggaataaggaagaaataatggttaggaaaaggaaacagaagcagtagatccccaaggccagtggtagtggatgcagccgagtgggtctcctagtcctgggtcaggggtcaggaaatcttcctccaataagaaggaaactctagcaaacccagctaggaatcacaatggctgccaggtcagctggggagaattaggctcatggaattcagctgctccagagccactaattaaactgtcttttaaagactgtaacttcttggatttgcatctgggcaatgtgcttcacctgcagggtcctgcagactatagatcaagtcttccttctgaaggcttctcagaacagctggggcccgcccacaacaggctcccctctgtttgtctcctccccgagaggggggcttccagctcccctctagtcagtcccttcctcccctgcagccacagcagccctcccaaaacaaagcctctgttaggtcacttccctgatcaaacaccaatatgatagtgtcgcactgtctaaagactttctatcatattacagactaagaacaaaacccttggcctggcccctgccaggaatggggccccattttacccttcaggggggtcaattccctgcatgctaagtaagtcttaaactctagccaaattgggtggccagctgctgtgcaggaggcccccccaggactctctacattatctcgaggtttcattaccagaatcctcacttttttctcctcccttggagattaagtgacttatccatcatattcaactgcaagagtaactgagcaactcaaccgactccacactctgtggagccacacggcctgtgttgaaatcccagctccaccagtcactggctatgagacccttggcaagtcatgagactgtgacatgaggctatgagacccttggccagactcactggctatgagacccttgtgccttagttgccttatctgtaaatggggcacattgcagatgtctcaggttatagttgcctcaactgcaaacagcagttaccacataataagggttaaattaattaatatttgtggtaatagggggagtagtgcctgtaatgcagcaaatgctatataagtgttaaatttaacaacagcaacaacacatacacacatcctccctgtgtactcagagttgcttgcacacagtaagagtagagactacactaattctagtcgtaacatgaatccaagttaaccaactagccatttcttagtaatgctgtgtcaacaagtctcactcccttggtgatgcagtatacacagaatatagatctctttggggagtgaccccatgctcagataagactaaaacatgatgctagcctcaaaagagaaacataatttttcagcaaatgttggtagtatgcctccctctgtctctcctcaccaatgagcatgacctgcttatgattactaggtccactccattctggtttccatttttggctgctctgtgcttgcagcttctaggcttcactgggagtcaaagatcccaaatgttaagatcgttttgaagagcatgctggcaaatgtcctaaatgtgctgggccagatgacaagcatccatctccgatgaaggaagtatccaactgaaatgatgggcaccatatgagaaggagaatcccaaggcatgatggaaaccacaggtgctgcagacccactgtccgtttctgtctggatggggaaggaaggcaggatgcagtgaagcctgtgccactgccccacaagcctctctcgagtgacttcacaccattattggtctgatactaatttgagacaatacccaatcacatcacaacaaattagccacagacacgtgatagcaatcaactcagggggcgatcctgaatgcgggctgggggattctccagctccgtgagccgcacgctcccacagatgtttctaaaagcgtcttcccagaggcccatttagagagaaattaaatgcaacttcgacttaattaacgttttaaatgataatgaatacaatgtagattcataggaggcatttacattgtgttgtaaaattgataaaaatttaataactctttgttaataagttatgtctccccagacccataaagcctaaggcgctgcaaactccacactgggtctaatcgaggctcctggtgcaggtggaggaaagaggcagagacggacttgacatttgctccaagcctgctctaattcaaacctctgcttgttcatcagtactttatttcatacagtaaaggtcaggatttgggctcaaggcagagccttgacaagaaagctcaagtggaaggcgggctggccctggcatctgtcgcctgagatagtggaggaggatggaagatgaggagctaactggccacatctgccctccaccatggaggtaagaggaagcattcactgcctggtggtagaagctgtcaggatgagtatcctgagaaccggccactgtcctgaaataaaaaagcaaacataatttctatgtcaccttgcataagggcctcttctgggcttacatgaggcatgccaacatcttttctagtttgtccttaaagagccgagtcatttattacagcatggtgtccctgggaagaaaggtgtcccatgatggggtatacacaaaggaccctgtcagcttccctcattctgacctttctccttcttgtttcccaatcctgtttcaaagaatttcttttgagaagttggctgccttttgcctactgttcccgtctcctttcatctacctgcagtacatcttcatagtgtattcatcttcaggaattcaaccatactctttttttggaaggtggtgaaagcacaacaaggtccccaaatacaagccagtgactttacctgacactcaactgaaacaaccagctatttattctggagaagaacccagtgtgttgggagctcttgacagatgagcgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccagtggctgcctaggccgatctgccactctgtttttacttcctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcctttttctgtctttttctcactggtagtggtggtggaaagaggggagtaattgattttagggcccagaagtaaaataagcaaatagaatttaggtttggggaatttgaggaagtcacctaaaactgcacataaaaggaatgagataattataggctgttgatttttaaatgtagcttattaaattaactctcctttaacaggcgttggagactgtcaggatagggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgatattacactaaactgattttggtacgtctcccttcaacctaatcatattggacttctctcagcttaaccatcggagttgaatgccttcttgtattatatttatacccaaaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgccagagttactgatgctttgtgactagaatcatgtcaggcaggtctcagcaggtctgaatcagtatggccctacgttgccactgcatcataattttaattgtccctttctattacatttagcaatcagatagcaggcaagactgaaataacaagaataaacttctaaagagagagaaaggtccattttacaaaattatagtgggaagaaatcgtactgattggaatctacttctatatttatgtgcatgtgtatgttgctagacattcattttttacatttaatagtactagaacacagctacttgtgaaaaagccgaggcccataccatcctgatgtcttttgagagagctgggactcttgcccaggaccatctgaagtggaaacaaaaccaagatgatcataaaatgacactctatgcactgattctagcctaccatattgaacatttcagtcttgccagaaataaaatccttttgtgatgaatccttatcggtcacaatttgccttacttttctgacaccttttattttgatttttgtctttcctaaactagtccttcccctctgaagttcttttggtcaacacagtctggccttccatctcctcctgagttcaacagaagacaactatcataatagcacatgactcaaccgatccacagtaatgggccacacctccatagaggggtgcaccgagcaggcagcccctgttgttagaaggcaggttttcagaactgtgtgagcacttttaatatattaccattcctctgggaaccagctacttctcttcccacttcacaaaacacataatgggactttgtgtttcaatttaacatcccttgaaaacggaaatttttccccttataagaaaaaaaatagagtaaagagggaaacgaaaggaaagagagaaatgaattaggcagtctccaaagcacactggctcaactgggaaactgcgaccaaagcaagctccataatagtataatgacctttaatgagtgtcttgggaaacaatacagccctagcataaaagacaaagggcaaaactcatcatggctctgctgacactaattcaaaatgattttcagaacaactaaagaatgtaagagaagtaatctgatccgcccatctgacctcactttgattcaagggcccttctcctgccatttctaattgtcaaaccctctacatttcacatctgttcatatttaatgaaaagcccactctcaccactgctcttgagtcaacttgctctgtcaaatgggcaccacccaactccaccaccagcgagggatgcctggggattgctattggagcactgccagtggaatttcacatagagacagacatttttataattggagaagaagggcttatgcaggcccaaaaaggggctcaaattggaatggatttttctaacttattattaatggtcaaaggtgagtggtctcacacagggatggatgaaatctgcttttgtttgatggagtgatgacggcaggacgactgatgaaacggagaaggcaaatcgccccctgagctgtcaataccagttaaggcttcaacacgcagcccaaagctccacgtgttccctggtgggggctgattttggaggcaagggagggacaacatgccactcacagaatgtttcttagagaatgggacaatcccaccccaaggttttcttctccctggtctccatcaatggttggattaaattgcacagctgagaaatccctctaattaagatttctcttggatataatggaaattacacacactgggcaccatggggtctacatgggggacacagagtgtgctgtgattggtattgttggccagtgccaagacatgaccaaggggccctagctcagagccagagtggctcctttcttttctccactgagtctaggctaaggttttagagcctcatgattatttgagaacagaagttgtgcattaggcagaagagtaacccgggggcttgtggttactttcaccaccatcagtcaaagagatgtgaccaattcatgccacctcaggccctcctctgctcttcctccccagcacctatctttgaacttggtgtcttgctgcacatcgtagacagacaagttctctgtgcagctgtgccctagcttatctctgtaatggcatgcaaactacagataactcttcaggggaaaataaagtgataaggattcatatggtagcatctaaggattgtaacagaaatctttccaagattttaggcccatatggcagtccacactccctctcaatgcaacctccattaggtattactttgaagtgaatcctgtcccttggcactgctctggagcagcaggaaatcgtgaatcagagagaatgactctctggtcctagatcaaagttttccaaatgcctctaatatggctcgatgcacaaatcatgctttgcacttgaactttgggcccaaacataagcacctggcatggcacacagtgaagtcccggttccctgagccctagaggcctcatggatcccggctacacagccgcactctgctgggaccagcctcaacaccagcacaggggagtcaagccagttcattttccatgggaataaatgcttaagagctcagtgatcttcttcctcctgtcgtcagtgtacacctacccctgctaggaaagtgtagctcaaccagctctgagcacttggaaggtgagaggacagggagcaagaggttagcaatatatgtgttggctgctttaaagaggaagggaggaagtgcagaaacgagaaccatctcctaccttctatgctaccaaaacatgaaaacaaagttatagttatacttcaagtaaagtcctccagtggaaccacagccttttctgcacttggaccaagacccacagtcccagggtctcaaactggagctttcaggaacttcacttatgaaccgtatcaggaaaacagcaaagtccatggggaagcaaggataagggaggtctcaggaaactggcacatctcagccttgccagctaccagctgcatagccttgacaggttctttaacatctctgagcttgtggatgacaaagaagactgacatcagaggcctgtgctatggactcagggatatcacagaggtttctgacttaaattttttgttggcatttggaatcacaattgctgcaagataccttagttaaacaggggctatactattggaaaaataaaagatattaatggaacagtccttcaaaatagtcatcattctgagaaaaagctctgtaatccactagcccagtgcaggctgacagacatagaaaactcgtttccagaacaaaagacaaaatctggcactggaggaatgaggcacaggttagagagacatagtaaaaagaaaatatatatatatatatatatatatatatatatatatatatatatccatctgcatcaaaactctgttgtattttggaaactatctaagaaactatctaagctcactaaaagcaattcaatgctagagctggcttgttctcgctacaccctttccttcctccctttgatacaattcaatttacagccatttcaaaaatattaacatgtacacttctgcatatctctgtattaatacagtaggtgatatgctgtcactttaatttccatttatatttatttaaaggagagagaggaaagatatcaccagactgtaatatcacagtcctgcatgctgttacgagaagcgtaagttaagaaaatcagaagggaggccttcctaggcacgtacacagagacataggcagctggggcaacatgtcagcacacaggagttcacactgggaagaagacatcagcccgactgactcagaaccacagggcacagcacaagacagggatgataccacagacagcacaaacatggaactacgtgtgttgaggttaaacttacaggcacggaaactggtggagcaatcattaacagagacagaagaaagtgggaaggctctctcaagggtgtccacgttaccacgcacacggcctgacatgcatgagcagtcacgctcagaacgtccgcaatcaaaacaacatgcccgtctcattctcttgtagatggacatcttggctataaccgtgtggttggatgggaggagaggaagagcggcaattaatggcaaggtcacacacagcaaggcagctggaagggagctgaagggatttaacacaggtcttagttcactttaacagtcttgacccagaaaaaaatgcagagtgattgttggtaacagtttggttgtacatcaaaaaagcagcgaaaatataaattgcctttatcgtctcccaaggctgttgcacatgatttttctcccctaggtaaagcggtgaccacaggaaaagggcatggctgaatacactcgggttctcaaatgggaagaagagcaaattatcgacagcaaaaaacgtaaccaacacttttcccctgatatgattaatacaggaggacaaaatatacacactgccaatcaatgaaattagctgcttatttggtataataaatggtttttgcaagatgcaaaaatatctaatatgtaggctttctaatttccatccatttctgggcattaggcagaggctgggacaagctttcatcaaattagatgtgaaacgattacgtgttaatacagtatctaaggatgcctttgctgaacttcccgagagtgagtttatatgatggctacaggaatttaaatttactcttgacagaacaaatatccaaatctgtccatataagaaatgcagctactcaagactaacgctgcagatttgacattaaaggcagttcacaaataagaaatcaccaaaagcatatgagatgttgctctattggaatgcatttagctactcatgggtgtattttctgcttaaagctgagaggatctgaaaatcgcatctgcctttctctccccaccaaatagaaattcaggaagcaatcaggctattggttaatcatattatttcttttttccttatacagaaaatattcgccaaaatcgattaaaactgacaaaacatgaaatagaagaataggttccacgtgaaatatcttaatgcaatttgcatgcagcattgatagctcttctaaagctggtatggtaggttctgcactgcctggggatccaaactgagtggtaacctataaaagttgttggaagtcagcatcgtagtttccaatgcccttcacctttgcctttcaagccaatttatatttcagtacaagagaaggtttttgtacctcattttgatgctacaacaggcaaacatgtttgcttatcacttatcatgaactggcctgcttctctcacgaggtgggagaagaattcacatttattctaagcattactgccaaatggtaaacctaaactgaggaggtgttattccctgcacccacaccttccattttgaaagtcatttcccccactctttctttttctttgtagagaatggttgcactcttattttaaaatatggcttgtggttttgccctctttgaatgttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacgtgttcttttagtgtcctagctagtctgttgttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggaaatattgatttgttatttacacagaagagggaaacaaggatgatttttttgcttcaccgtagataaatcattttgaaaaacaatttttttaatcaaatgctgtagcagaagagaagcccatcaaactctggaatgctatgcttctcattagcaacggtccctggttttcatttccatactgccattttgggtttatgtacaataatagaatctgacacatttgtggagaaagaaagttcttataaatataccgtctttaaggataaggggagggatgatggggatgaaataacttttgaaactatttgttcagaggcaaacagatcagaatgggtgatgtaaacctcctccttgatatgagttcaggaggaaacacagtgacaaaccagtggctctcagggactgtttgcaactgttattgttagccgttctggcgaccatgcattgttctaaaatttcttattgttagcatgcaggaacaggctgaaactggtaatcgaagcagcaaaaaaccatgtgctataagaagattaactgttaattataagcagtcacattccaaagcagcatatgcataaaaaagaaaacatgctattacttgtcattccttcccaatcatttttacactcacaccaaatgcaaaatagaaatctcaaaagacaaacaagtgccaccacacacacacacacacacacacacacacacacacacacaaaatcagcaagaacgatcaatgagaggctcaaagacaagacagaaacagttaaaaactattgagccccacatgttgacaaaccttcatgaatcagaatgtctagatcaaggtgccaccaactgggaaggtggctctttttcgctactgctggcatagtccatttccattgactccctgtcaggtatcttcacctagagacttctgggtccactttcttaaaaggtaagacctcccatctggtggagcgattcatcaggcttgaaggatatgagtactggccaggaagagctctcctctgggccattatacaaatcatgaacaaactctttaactaaaagctgatgaggagttgtctccctggtggtagatgttccagaagaattgaacactctctgtgtaaaattatactcttaagttgtaaaattaaattatatcaaagttaagtcatggacctcctaatttggaaattaccacccctcatctctctcaactctctctggcttcctaacccttcaattttgttacagtgaatcatggatattcagaaccactggtgttttgtttccatttctcagtgactgtttccttttctagagctgatttaggttagaaggttaattttagatatgaagagttccactttaaattcccaaggttaggtctcaaagtgcaactttgaaaatttcaggatttatttcaaacagaagtaagtttcttatctactccctggccacacaaagcatcctctctcctttggtgtttgctaattttctttcttacgtagtcacccattgttcccttcccaaatcccaattctcagacaaggttttccccaggatgtcaatggtaatacaaagtagatctatgaggacatctagtggatcaatgtggaagagcagctagttcatgggcagttggaactagcctttctccaaaaggagcagaaagaggaccctgctgtctctgagaattgaaatatatgcagtgtcatttcaattcaatggcttctcatgatccacagcagatgattaggggtaggggcagtgaaagggtgagaggtcctaggagatgagcctagggtctgcagccacagctggcacaggaggactatttcagtggcagctgactgcgtctcctttttaaagccctgctgcagcttcctgagactgggagcagacaagagtgtgtctctggcaagtgtgaacaccaaagctacttgtcattccatcttagggctcttgaaacttcatgctcaattaactgccccgataggccaacttaactctaggaaagcagaaatacaaggctctagggactcagtttaccctctggttcacatcataaggttcttgttattggaccagggccatggattctatgaggttatgtggttgctaagaatttgaccctgagtctcaccttcctccgaagacctaggtcctggcagtttcacaatttgagaaaaagcttttatgtgcttttcttcaccacagtgaagtggatattcaaccaacatttccatcataacttcatagtactatttacagagacaaaatagaagtatttccctaatggacatcatcaaaactatttgtttactcttgagtgtttaaaacaaaaaggcttctcagaagtgttcttggacaacttttcctctattctcaaaggccatgatcatgagaccagaaacctgttggaaagtggctggtgaagatgcagctcagttactgctctttccttgagtcaaatggataatcagctgtcaaactcaggttctctgctggctggcctttctgagccaagcctggaatggaaggaagaattggattccatcctatcctcagcaccatctgccacctgcatcagcaaccaaattgtcagccaatttccaatgcagaatcttaatttccagggtggattggaagaggcaggaaaaagcagtactggactgaggggcccaggtggagttttccaactgctggggaaaatgttttagatttcaaatggagcaaattcaagggaagactgggatggaagaaaaaaaacatctgccattcaatcaatagatacttttcaggtcacagcctcacttttaaaatcagtcaaatgaaggagggattatttccaagcaagaaacatggagctactcttcatgggctctgcagcaactaacgttactaataaaaatatccacggaagaaaaagtccaccaggatttaaggtgaggcctttgatgtggcactgggaatcagagaatattctttcaagtcctataaatgagaaatgatgtcttcacttagcaaaattcctcccattaccttctggagtaagaagaaaggtcttccaggtggttttccaaaaacagaggagaaagaaaaagctagttaatgtcagcagcacagagcacactgagctagttgattctgcccctaatgactgtattgtggctgaggaaggcagaagtatttggcactagagttgttggttgattgacaccacattttctctccaattctgaaggaccattcaatttagtatgcagctctgcaggtatgaaagtgggccatgccctcaagccatgtttaaagggttctgtcgatgaagaaagccacagagtcgattttggcaagactgtgcattgaattgaagaaggtcatcattgtgttttgtttttaaagtgagcaatctataccctccaaacactgatgactaaccaaaatcagatgatcaacttgcctcttttgctgcaaaggaatgaggggactgaatttgaaacatcttctccaaattccagagccattggactgaactgttccacagattgggtctccttttcagtagagccttacaaacatgaataaagacccaaagctcaatgctggccttaaaagctcctcctcaatggccacatcttgttgagtaaaagggcatcctattccttgagtaagttagaggttcagacacttgtattgacttgttcagacttatacattgctcattgctgaaatggaatgttctcctccagtcagcttttctgccttaaacaggtaaagggatcttccaagatgtctgactaacattcataaagcaactgggtgtgtcctactgagtactgactaaaagaaaaactttgttgtaaagcaagggaacttcatagactgcagataataattaccactgtgcaaatacttgtctccagtaagacaattgagatacttacagtcccaaagttgagtaaccaattaattatctagcaagcacttctcatacagagaagcatgtactgcaataaatacatcactctatggaatatctctactcttatatgtaaaaatatgaatttttacatataagaatgtacatatactctgatacatcatggtacatattgtgtgtgtgtatatatatatatatatatatatgtatcacaacatgggaatatatatgtggcatatgtgtttcctttaggagaggaatccaagctcaataacaaaggagaccaagtataatttatcaaaggcaagcatgacaattaccccagctgatgaagcatctggagttatagtggtaattacttcagcctaatcagtgtcccttaaaagtcctgagacaaggccttcaagagaaacacactgttgtcaaggtcttattttcaaatagaaaaataagacagtgcccgaagctggccagagcccggggactggggtggatggatggagagcaggctccctggggactctctggctccaggctactctgtagactgcattgggggatgaaggagttggggcatgatgtcactgctacatgcaacataaataccaaaagtaaaagggaaactaaaactgtacagaaaattaaaagagtatctcttctagagaaagacagggggaactggactccgggctgctgggaacccgttttactcacaatatatcactaccagtgtgcagttaaaatagagtaggggccgtattccaaggcagcaaagagaaaaaaaataaatcaaagatatgtcaatgatttgaagtcaaagaaaattccttcaaacacatcaaactagacattacttgtccactaggagtccacactttggcaaacttttagagtctgggggaagaaatgtaaatcattagacaaggtttgttatatagaaaaagaaaatgagtaaatagtagaccctgagaacttgctcctcggccagacagctgaatttgactcttttccttgatagagagctatgaagaaatggaaagaaatgcaaacgttaaactatactatcacaggatttccagaaatggaatgtccgcacctgatatttctccggatgagatgacgtgaaatgttgaaggttactgaatgaaagtgaatgaggagctaggggtggaagtgaaaggggaaggctgggttggggaaggagggttaggaagctatgggtaagggccagtgactgtcatgagctctgccctcatgggatctaccattccagggtgaattattaatacctggactaacacgtttggacagatgagtatgtgggtcagctgtcttctccaacttagagagggaaccaagcaatgtctgttcgaaggcatgggggtccccccagtgtgttactaataatcctagtttcttctaattaaagtttctttgcaactaaaacatcttctccaatttcctcacttgcctgacctacatggggaggtttatttttaataattcattttattctaaccaccccctcacctcacacacacatctgcatcctgccctctgttctatggccttttaattagtaggagcaatattcagacaattctgattgttacatagccaaaggcctttgtgagatgaagaagctgaggttgggggaggaggcacagggatgtacagagaaggaagcgaggcccttgttacactggcttggctttgtagaggcaggccttttgcagcaattggtgcagtgcataatgggagattatatacctcactagctccaccaactttaaaggaaatgaagagaagaaaattatttcaaacaattatgggcctctctctccaggatgaagctaaagcctgctgctgtttacctgtctggaaccaaggtggaaaaataccctagaggccaaatccttatttcttatttctagggacaatttagtctgctgtgttccactatggcgtcctatgagggacattccaatgtcagagcaagagtcagagaagttctcacttcatccttccacttccactccttcctcccgagaatgctctccatccagacaccagggacatcttttaaactaagaactaatgatgacatttcctcacttaaaatcttccaaaggcttcctaatataggactaaaacccacacttcttaccacgtcccctgtctccgtctctaatctcatctcatactaccctttccccagtgccactggcctttcttccatccttcaaacaccacaaacttattcctgcctcctgaccttgacctttgctcgtctccctatctggattgggtcttggcctcaacatcacccctgactgaggccttcctgaccttccaagctataaagtagcaccactgcaggattcctcaaccctcaggcagtctcttctctcttcttagcactggctatctctgaatttatttatttacatcatcatggtttgtctccattcaccagagtaaaggattcaggagggcagggactttaccttgttgaccactccatccctgaaaccaaaaatagcagctcatccaaagaagatactcaaaaatatgtgaacggctaatcaatatgtgaatcacagtcttgctatttccttgatactctgtgggatgagggtctggcaaatatcctgtcaggggttattggcctcacctttcctccctttcccaacccctcactacaagcgtttctttacagaagtgttcacctcttgtatttgttgttctctcttatttccctcaaccctcagactgctgtgctccttctgattgaaatgattcaggagatgtctggtcaactcatccgtgctgctgtgtccacaaccaactaagcatggctgggatggactgcctggtgaagaaggtctttggattcatggggtctgtgggggttgaatggggagtgaggttcattctaggccttgttctctcttagatgctcttctcggtaggttgtcagaatcggggaattcttgtcccaagaaattagaggctcttgttttgagatatcaataaatactcatctcgataagagtctgggggaaggggaccagctgtattaagtcagtggaaacagggggaggaaacccatggtcctaagctgccccaccctgaggggatttctgcagaaacttctctagaccaagagtgcaccccaagggaattttccccatgggttgaggaacttctttaccctccagcagagtgatatttatagatgactggttctacattttctgtaccccactctaggagtacaatgaaaaaggtccttccttcagtggcatactttaggaatggtgctcttctgtctggcttctgcttgtgaacaaggattttatggggtactctttcataattgttcttactcatcagacccaagactgcccacattgcctttcccttctgcaaaaaaatgttagagcacccagagaatcaatagaggccttcaggtgtgcccaaatccctgtatgttggctgtgtgactgtcagcaatctcatcctctcaaacttggaagcttagtttcctctttttgtaaaatgggattaataacacccctgccaattacatggggttagggtgagaatcaaagcaatgattataaggagcttttaaaagactaactcaccataggaaggatggcatcattttttgtttgtttttcaagggttgagaacaatttctattaggcaatacagcataattactgcaaaaggcacaaccttctcaaagcaaagaccacttaagtcatggtatctcaggagctcacaattccacgttctggactcactatatctttctcaagaggccccagtggcaaactgctttagaagggacttgagacagaatatgccagaaacaactgagcccagtctagtctaccccaaagagcgatgatgcttgaggtcgacctttggacgatggcaactgaagccctttggcagtggaaagttcttttcttgggggcagtctgaaggtatcacagttgccaactctggcctgtggtattaaaactagcaggaattccaaatggaaagagtcaactcccattttggagaccaagtcctcagatttagtttctctctcaaccctatatactcagggacccccaatccactggaaatcacgatacaaaaacactttgtgctctgtggctttagttctcctccttattatacatcatacttgtctctgttagactggacacatctactgaggcacctctagagtaaagaagcagggactaggcacaggtttcattcctaggtgttgatggtggtgatttttcatcctctgctctaacaaagcaaggacaggtatttatttcatatttctttaaactgctgggtgaaacataaacatactcaagaaaactctcgatgtttagtgtttctctaataagaaaagggaaggaaaaggaatttggggaataggaatgagaaagggaggggacagggagagaaacactacttacgccgtttgcagccacatttttttattcttttgggatctgtgatgtcatcatgacaggccttgcagtaaaaaaatgccctggagaaagagaatggaaaaactgacacgtttcataatccacccaaatgaaatgagtaccacatttcctccacggtggtgccaaattaatgaaacacgccagcattaatttcctttaatcttttgaaaggtttagacatttgcagacggaaatgtttgttgcaagaccatttatttcaaacacaggattctgtgatttgagttagtgctccttttcataaacttccatttacaaagaaactgggaaaaaagttgctgatgtgacacactgtgtctgctcattcgtctttcatttttgagaacagcctttgatgctactcgtggggacatgtgggcaatgagccctgggcccttggtggggaagttaaatacaacaccaaaattcccacagtctggtcaaatatatatttgagggggcagaagtatgtcgtttctcagtcaaataaaaatatcaagcttgtcactctgaaagcaccttttctgggcagccaaagggagacagagttgaggaggtctgcagagagggaaaaacgaaagccacgagtcagtgggttcctctgtcaaaccccctctggagtttcacagcttattttactccaaagctgactggaccaattcccatgctatccagccctgagaacatgcactaaatgatggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgcattagctgtgtcaaagatattctggataagaaaaataagatcattcaagcactatttgaaatcacagtgcctagaacagcacaagaggcctgtgccctttcagtactggggaggtgataaaattcactggaacaaccctacaaccttctggatccaagaactaacaaaatccctggcttgttgcctttaccactcccaacaggaaactgaatgccagctatgaacatggccttttcttgaccagggctgcagaaataaacacaattcttgaccatttgattcttaggttcctttttatgttttcacaggacttgatttataattggcactcattggaaaccaatgttaagacttttggatccacacgaggtcttggagatcctgcagcctaaatctctgggactcagtgtcctcatctgtaaactgaggaggttgtcgtggactgcccagtcattccatgctgggattcagccagccccaggacttctgaatccaagtccaatgcttgctctatcctagcaaattctccactctttctttaaatgccagctgtcatctatgtctcaaaaaaattaaaaaaaaaataaaaagaaatcctagctgactgttgaccctgagtggcaatgtggctaagaacccaatcaatctgccttggcacaggaagaacaggaaagtagaaagcatccaagttggggaaagtaactctgcgtccacttcctttggccattttccctccccctttgttgctcttaacacataatgataataacggtaacaatcatatagctaacatctatagagaacagactacatgtcaggtgtggttctaagtattttataagcattaaacatatttgatcctcaaacaaccctttgaaggaggtatgattattatttctattttacagataaggaaactgaagcacagagaagttaagtgacctgcccaaggccacacagctaaaagtaccaaagctgagattgaattcacatagcctggcaccagagcccaaggtctatactaaagagatgatgacatgataataagcctgaatagacttgtgaaaagataaagtttgattacttcatgaactaaagttggattcttttttaatttaatttttatttttaattgacaaataataattgtattatatgtgtggtatgcaacacattgaaatacatatacaatgtggaatagttgaatcaagctaattaacatatacattatacagataaagaaactgaagcacaccttttgtggtacgaacacttaaaatctactgtcttggctgggtgtggcggctgacgcctgtaatccaacactttgggaggctgatgtggatagatcacgaggccaggagtttgagaccagcctggccaacatggtgaaaccctgtctctactaaaaataaaaaaattagccagtcatggtggcatgcacctgtaatcccagctccttgggaggctgaggcaggagaatcgcttgaatccaggaggtggaggttgcagtgagccgagattgtgccactgcactccagcctgggagcctgggcaatagagcaagacattgtctcaaaaaaaaaaaaaaaaaaatctgtctttgcaattttctggtatataattcatttttaactatagtcaccacattgaacaatagatttcttgaacttattccacctgtctaactgaaatttcatgttttagatggacatctccccaatccctcccaaccccagcccctgttaaccaccattccactttctgcttctatgagtttaacttttgtaggttccacatgtaaataagaacatgcgatgtttgcctggcttatttcactaagcataatgtcctccaaggctaggcaattaaggttaataagtgaaatgaggcaagggtcgggggtgtccatggtgatctggagcaggcagagtatctaagctcagctgacctctgccaagtggcatttctttgcaagaatcattctcttccccacccatctttgcctctgtcatgctcacctcgcaaagcccctcccttactgcacacctgcacctgagcaacggagtttcgctgggaaagaaaacatgctgacctcactttaaacccacaaccatggatttcaggggccttttccactctttgggatctaccccattctcctgttgcttgctttctcacactccaaaacagctctctctcctctcctctccacttgctccagctcaccgtacccctcccacaagcagccttcagctggtgatcttgcttcacccatcatcagaccagctttgtgtcctgcaaggctggcctgtatggtctccttgtcctctggtttcctggcctgcgtgtccagtggaaggagtcagcaggagactagggtgaggggggatgaggtcaccaccttgaccccccgggtgccctcctgtacaggtctatgaaatggcacacgacagcctctctctccagctcctgatagccctccttccccttgaccccacagatctagggtgaaggtggcttcccctttcttgctagctctgcagtgcttggccatcccttgttggttttcctttactatttgcccataactttacagtctcttcataaaactctcctcctttttcccatttaagtttgtcatctgtttcttgccaggacaagaaacagcacccacatttacatattcatctccaattcacacttatccccagaactccagactctaagatccaaccgccttatgatatcactgtgtgtatgtttagtacacatctcctacctaacatagcccagatagaatgcttaacttcctactacccaaaacttgctccttctctagtatccctcatcttggttaagatcaacacaatctaagccctgactctagccttcatccttcattcctcttttttcctcacttctgcccaattcattggggggttctgcacactctcccaaatacagtctgaatgggaacccacctctctccacctccactcaggggtcagtccaagctgccatcatctctcacctaaactatgcaataggcgctgagtctctcacctcttctcctgccccattcctctcattctctacaatgcaggaagaatgaccttttcaaaatatacatcagatcagcttaaagccatcaatgacttccattttataacagatccaacctttctataaagtgctttaggagccagcctctgcctctctctaacctcatctcataccactctccccaaatctattccctagccgcactttccttcttggggtccctatccacaatgaacttcttcccagcccatctcttcttcctatctgatccctgcctgatggattatttcccttcatctcaatctctgctcaaataccaacccctctgagaagctttcacttatacccaacccaaatcagtgacccagttgcattaattcttttaccactaattattttttaaaaaactgtaattctttcctgcctagaatatgagccccacgagagttgggacttctccccattgttcatttttcaccactgtttccctggtgccttgtatagagccttctaaatgtaaacgacttatacacatttgatgggcgaatgaatgagtgagtttgagactgcttcccggtattgttgggtctgccaatttttcaggagaaatgagtaataaggatttttatataaaagctcgtaacttttttcaccttggcaactcatttgtattttaaaattgtgactcaaaaggatcatatgtgcaagccaaactgagtcactgagccaccgttttgtgactcctatattaaagtctatgttccaacgttattttaaaaggaaaatatttggtggcaaggaggaaagagcaagtacccaaatgcccatcctcaagtgaccttcttaagactgcagtgggatggtttcactcctcatttactaaaacactgcatctgaaggtttctacaagctagaattcattaacttcttttgttgcttttttgcagtggagggtgcaaactcgatacgagatcatcataatctacttttccatttttacaaagcttgtttagtttcattcaaatctccaatgtcctttctgtggttttttgcagtcttcatctatttgagatcccctaactgacagcatttgctttgacacatcacatgccatggaaaattacagcctggtgttgtagctgattgtgtcagcatgtatttgtgaataccataaagcactgaaatgagacatattgcactccctaatataggaggtaatttgttttttggacggcctgatatttgtgacattcattagtgagagatgcaataggaaatagaattacacaaatgggagtttcatgttatatttgctatctgggaggtatacgtgatatatggttctcctgtgctccccagcctcctgtacttggtgctgagatgctgtttcaagcttttgtgtctcacagtctggacaagggcacaagcttcttctccaggagacctgattggagcacagggagagggaaggttcagtcccattaatcctaatttcccttctcaggtgtacccagttctcaggatactcttgaacaaccgggagattctgtgaactgagtagggaggtatttttcccccacaactcaatcatggcaatctttccccaatttgcagaaataaatttaagttattagagcactcagtttaagaattctttttccttccaacagcccatgttttctttttcccaaaagcttctgtagccagtatggcttagtttgctagagtggatggggaggaagaggaccctaagtatccacggtcacatgtcatcgttctgtgctcagcgtatcaggcttaacctaggcaaataattaagagtgcaagctccaacttcctggctttattcctcactagcagtatggctttgggcaagttagttagccaagttgtgcctcagtttcctcatatgtaaagtgggaaagagtaatgctacctatctcatggggttgcgtgagagtttaacaagttttagatacagagaacctagtacctagaatagtgctggggtgtaataaaccctcctctgtaagaatgtggtagtattattaaatttggtagaaagagagtggattttagaaaaggaaagaccagttccactctgggctccaccacttacttatgtgcctcatggccttggacaaatcacttatctcgattttacagatgaggaaaccaaagctctgagtgtttgagaagacttaccttccagggttattttgaagagcagcaataaagaatgtagcacacctagaacaggcctggctttgactaggaactcattcaatgaagacaataggcttatataactaatgatagaccttcacaattaataatgtacttaaaatattttatgcaatattactgttgagctgaatgacctgtctgaacatttgcatcacattttctgctagtaaatttctccaagttcataagatagaatcaaatacaataatattccatgttgtgctgcaaagggccctgtgaattcctaggctgcttaaacaggtttaaggatacgaataaaaatgtcatgaaacatgtaggccagtgaaatcctgtgctgcacttacagtggcttaacaattgaagctgacaacttcagccacttacctaggaggccacaaatagaaatagagccagtttcatattccatctgaaattaatcccaaccttttgaaattctatttggcagggagagtagtagaaaactgataattctcaagtaaatttcccagataatattaagtaaagagcactagataaggagccagttgtcttgttatgttgttctgaatcatcaggaatcaggatgacctcgagcagtcattcagctctctgagcccccattttctccctcacaaaataaatgagcaggtaactaggcttcctagttctaaaattttattattctcattcaaagatgtggaattcactacatgaactggagtccgtggaagtttttcttacaccagttgatggccatagacatgttaaggagttttggggttatggaagcctgcctacttccgtgggtcaaggtgtctacagccgggccagaaagaaagccagttgaaaataaactcttaccttttaacttctttggcatcacttgcgatgaaaaatcctaaagtaccttcttggatcttaagatggtttccaggattaattaatatactgctcagtgaacaaaaacaaacagagaagatacatttgtgaggtcatgttctgaataaaaccttgaaggctacaccatactgttgtgtttatagggggcccactagtctaaagctttccccaaagattttgtccagagtccaatgtccactgccccatacatttagttggataatgccatcattaagcactactgcttacttcccaggctggcatgctcccagttgaggaaatcaaagcaaatcaaggtattagggcctgggtttatataatggagcagtctagctgccatcatgggcacatgatttgaagcaaagtccatcagaataaattccttttgaaactgctattggtggtcaacacggaagcattattggcctgatgaagctattgctacaacaattttccattaaatgacagagcattaatgggacccctatagatatacataaacatcatgtacacacaccacatattaccgcagggaatggtacaagacacccgtaaccaatgcggaagcaagctgaacgtcttcatgacattgataaggacatggaaattgattccatgtacagcctttataggaagaattggatttacccaaacagtttttttttttaagtcagcagttggatatacttaacaattccagtctgctgtttataaaaacgtacagggtgtttgaataagatgtgtgtctagcatgtcctaattgaggcaaattgagaaaacaaatgcaaacctccccttaaaaaaacttgccctgcagagaagtgggaacctaaatatacattgtcctatttcaaagtggcataaatagattagcggaccaagttgtgtttggactgacagaagagataaatgtatcctaatctaataaatggatgaaacaaacaagtttaattttctgcagatcaaaagcagaatacaagattgtctgatgcagagactgagaaaagacttcaggcttaatggatactgaattcagggattctgaataaaacaacagatacaacagaggtattccttgttctgaaaagatgttgcttaataaggtaatagatatttggaatcagtctaaaggaagttctcagctgccccaaacaatcaaaatatagaggatggtaattaacacataatcttttttcctactgataaaccattccagagaagtgttgtggtcatgaagtgatacgtctgtagtcatacaggaaggacccaggtgaacctttgttcacctggttgggagacctccgagcagatcattattgcaaaataattttttgtggtcacaagaacatctaccattacttataacaatacctgacaggaggaaactgtacttgtgtcatgactattattaacactcaataataccaaaaggctatgaagatttaactgttctgccctacaaccacaggcagcagtgagattcctcccaaatcagacagcagcagtccacactaatagcacggcctgcactgagcagcggctctccataagcacctcctaatgacccctccgccaactcttcacatgggtataacaagccctctgacttcatgcaatcacgagggtgaagtgttagagctcatacagtttagatgaatttatctttcaaagccaattcagtatgatgttttagaaaggcaggattataaattttgcacatttttttaacctcctttcctgcaaggcagtttttacatgccctggctctgcaatcagaatttgggtccaaattccaacactaccacttaatagctgtttgactttgggccagttactaaatatccctagaactcaactttcttacctacaagaggtggataatggtaacaataatctttagagaattaagagagatgatgtatagaaggctcaatgcatgtgggttattgttcctttttttaattcttgcaaaaaaaaatccaaagtgtatttcattttcaacaaagttatcacagattttctctagctgaccccatggaatataatacagtcttcttatcaaaataccttgcccattaatgagatgaaattatagggtaaagaactgtacgctacagaataatgtataaggacatacacaaaaaattccatgcactggctttgcaaatgcaggtaagcctcacacttctcatctgtaaaatgggtcctggctttgcaaatgcaggtaagcctcacacttctcatctgtaaaatgggtgaataatcgctagcttacaatgcctctaagagagttaaagtatgtactatgtgctacatgactgacacatagaaggtcttaaattcttagttgctactctcagtgagctaggtgattataaaactgagaggtaaaaaaatcctcacagcaccatcaccctccactttgtccctgctgctaataaatgacccaggaggtgccctattggcattgaaagacttttccactgactgcaaggaaatccaaagcattttatccctgcacaatatctggtgatgggctaatttagactgacttttgtctgcacagtgaagtatcctgtgttccttaaatctatggctgattgtgtaaggaatcgaaagcatctctaattacctcacagatcatgtggattccaggatgccctcttattccctgtgaacaggggtgagggggtttaaatcatccccatgtgaggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccgtcttcttcaaaatataaaaagacaaggattctggatagtgataaccttctcccccttttgcctactatctttagaattcgttattgaccttctaataggaacacataaatttttccaaggatctctgatctctttaggagagtatccaatgttaagtttgttttgttctactgactgccaaaagtctctctctctgtgcgccactctgaatcagttctctagctccaactttatataattcactagtttatcagagataaacttcaacatgtgtcatgtgaagaatcaggaaaatctctaagagaaaaagcccatatatccattaacagaattccaacaaggacatgttggcagaggtggactttccctcatttcaaggaacatataaattatcctttcttctttgaccttactggtttcaacagaaaacatccagtgacagctggaagcacggggctggtgtggtcccttgctgtctctgtttcttttgctctcagactagttttaagtctcgacttattctttgtttactcacctcctacatggagcaaatacgtattttctgtaaggaacccacagttgagtagaggggtacaaaacatgatcacattctatttacctttgagtttcctggagtagcaggcttagagccttgcacgcaacaggcacatttcaactatttgttgaatgaataaaaaaaataagtttttaaagcctcagttccataagttttcctttttttcacaaataagtggaaaggaggtcacagttttctttcaaagaacaagctacaattctcatcagtcaggccgattaaaggagtgaccacacctctgctagggctaggggattggccaatgatctagcaatctctcagatgtgttaagtatgaatatgtaaatatcccaatatgtaaacagcctgccacttgcaaagttggggcaattgatttcaacattgaaagcaaaacttcaaagagaaatatgggttcctagacataaaacacatctacgtgcaattggctagcggggctcagtcccgcagggaaatgcctctatcaggtccctccatgagaggagcaccgcgtctcaagttgtatcacatttcattgggtatctctcgctaaacactggtcaggttggaagactgcagcttgatggaggaaagtaatgcattcctttctccaccacttgtgcataactgggggacatctagttttgtcttcaatcattgtaaactttacttgtttcctgtttctgaagacaacctatgattcgtaattcaagtgaaacagatattgtttaaggaaacttctatccattatgggtaaatatgatacatatatatttctctcctctccctttcatttttggtaggtgtaatgtaccattcctcaggcaatttttaaaaaatagcatgacttatatgagaacatactttgtgcttgataacgtagtaattatatttgtgtctagcaagctaatgggacttcattaactaaagcaagcaaataagaaccatttagggtttccattcatgctatgcccagatgaatcatgccattgagaagaggcttctttgatcacacaagttcatatacaatgactctcagttggaactttgtttgaaccaatccgtgtcccctctcagagagtatgactgcatttgtagtttacaggctatgtgcaggcacagttcagagaaaccccacatctcaaatcttatcacctttctggaacttttcattttttctgggctttcaaatacatgctgctgctggagtcccacacaactagacacacacacttttactttaggataccattggagacacagttgtgtatttcatatgtcaatatacttaagcccagttcacttacacacagacagcatgataaagattgctcccagttggtcagactcaaatgactgccactgtggtccaccagagatactggtgaggacttactcagcctgcatccatctcagtaactttagaaatggcattttcaaatatatttcgtacatacaaaaaaatattagccatatgggatggggaacagagaggtgatctagaaaggataatgctggatatttggttctgggagcaagccaaatcattttctggtatacttaggacaagtcatgcctacatcacaacatgccttcaccacaagataaaaggactcaaaggccaaaagccaacagcagaggtgcaaccactgtggacctttaagatgcaaagtgttgcagtaacttcttgcagttggatcatatcaataataccaaactgacaggaagccacctctatttatacacatgtactcaaaaaaacaacagaagaatcagattttggaaaaagatacagacaaatacacacgcacagacacacacacacacacaattacaaacacaaacacatgacagtgattacaatcacagagaaaagtaacttgaaaagatgaacaagtaggcatctcaacagtatgttttcaacaatattgtcttagataacacattattgaaaagctatcctggaactattaacccaaaagtttttttttaaatgccattgatgatgatttagtcatgcttcatgcaatgtaaaacagcagcaaaacagggtgaaatcacatggtgaaaattgagaaacttcatattaagaaatatgcccaaacacactaggaaaaaaaagccatgagtctgtctcaataaacagtactaactctgtaaatcaagtgtgataatctggcaatttaatagcagtgttctaagactatactgagcactgcccaagaaataaaatattcaaaatgttatcaccaaaataaatgtaaggaaaaatagaagtgtaagggcttggtctctgttttgtggataaaaggacaggaattctgctctatagacaagaaactcgacacagggaggaggaggtcactgggaatgtggaagtggtatgtagacaaaatggcactagagtgcaatggacatcaagacacgtcaggacaatacagaaacagacacaaagggctggagagaagcatcctcctgttcaactttaatagtatttgttcccattattggtgccatgactgaaaacaggagtgtgcctttcctttcttaggtttcctgcaaagaagttagtgcgtcatccaaaagaaccaacaaatcaaacaggaacagaaataggctacttccaatttatgtactctagttggagaggggtgtgtgtgtatatatatatatatatatatatatatatatatatatatacacacacacatatataatatagatacaccagacaagggaatgagattatatatacatatatataatctctctcttcttgaattcttggcaaatggttagtcctgtggttaggagtgaagatagagggtggaggttggaagaaaagttaacgaagagtgcataccgctttcggcttctgcaaaacgacaagaaaagaatttaaaatcaaacaatttgataataaatcgactgacaccagaaggaaagaaggaataaaacctttgtttcaaatcacttgaaggatgcatgtgaaaacaaggttttttggcaaagcatgaaaacagtatcatggggtgaaaccaacaacaaaggcagttaaacacaggttaaagaaggtgggaaggagaaacaggtcctttgaattttcacacccagtcagttagaaaatgtgagagggaaagaagtgggacatgtttaaataaagaaaaacattaaaattattatctcagggaagattttaaaaaatgtgtgttttcacgtggatattgtgtttgataagtcctgtgttttctcagaggcatgatccacattccctcaaacacacctttttccacaagaaccaatgtgcttccacactgagaccaagccacatttgagaattaaagctggcaactgcacaaagaaagcccaaacaaagccaaacaagtcctttttgcccttttctgaagaaaaaaaaaatatatatatatatatatatactaaaaactatatctacaaatatggctttgttgaaaacatctcagaattgtgactcaattgaagggcctatccaagaaaagtttcatcttcagggagtgctctgagttagttttcttagaatagtgacattgagttcacaatgaaccattaacagcctttcgctctttttctctccttggaaccaaaaggcaacaagtgaaagacaactgctcaaggttcagggtgcaatctcctgcagtcagattattccagaatggtcgaaaaacactatgcagcatcagcatcacccacatcatgacatttttttttgaaagatgcacaaaagtaaatagagaacactgagttacacaaagatttgcgatttcgcaacacggggaatatcatttgcaaaaatccaggatacatacagttcccctacacaggtacaagtgagtattggcaaaaacatgggtaaacagtaaccccagaaaattccacctcatctgctgaacaactaataatcaggactgtcagtttttgcaaacaatattcttcactttgccaacatgaaaaagaaaatatttatctatctacatatttgttaactgctacagccatgttctacatatggccaccaaatctaccatttttttcttccttttggttgatttgggttttcaaaatagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaaggtgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccctcatcagtctgatttgcacataattaagtgtaaaataaataaataaagagagctcctgcctctgagctccactctcctggctcatttacatgaagctgatattctgccacctggattttggttgcaccgggagaagcacatatggtacacaataggctgcttgtaatttggctatcaagagagttggtgtctcccctcacagctctaccccaaggctgctgtaaaggaggccagagtccacctgcttttttgctcacagcagtaaaaaggggttttaagttctggtttaatacttagaaggtgaaaagtccaggtcggcatgatcaggtggagatattttgaggactcatccctcttccctggagaaacactctctgaatgcccagcagggctttgggtgccaggctggtctggcatagaagctgcagtgtctgatggggcatgcctcgaaatgtgctctagggtcagagaggttttacatctggttccatgcagataaataatgcacaagaaagcagaagtgaaccgaccgttctcagaacgcactctcaccatcaaaagtgtcagctggctgctgggtcaccgcaaacttaccggctctctcggttggcagacttgtactcaatggctatcattaggagcttgagcttcacaaaacacagcctgcaatgagatggagaagcctcccaatcagttcttctgaatgaccagagccacataacacacactattacgatctttcggtctcctaatgcagtcattaccgaggggatcctcattccaccggcactgtgccaaagggagggggtggaagcaacacctccccatcttccctattaaacctgatttcttgcaagtgataaggtgctggatgctcaaagtgcaaattgcactcaggtctggctgtctagacacagagcccaagcaggaatttgtgcctggggatttactctgggccagattcattagttactcggtcgggtagtaaaatgttaactacagggggagggaaagatttggaccagctggacctgttatttggattccgtttcggtcttttgtacaaatggctcatattgttgttccgagcagacccctgtgtgcttgcaatgatggtaataatacttggcctctgtgtaagtgcccagcacatgacgatggcattgtcactcctggctccatccaagctgtctcacctcatctgcttggtgctctcgactgcagagcagactgctttgaggctggcttgttcctgtttccatcccttcccttgtgcgttccccactctcgatcccttcttctctcttcccaacccatcctcacaggccacgtcaactctaatcttgcaagcagtgggtcttctccagctactgctaccctgtgattttctattctcaaaactctcccagcaccttgtctgtaaccaaatcactgagcctttagtcaattttacactggctgtggtcgctccctattgtttcatgtgtctgaactttgtctccttaaccagagcaacttccttaagagtcctggacttgtttggaattctccatagtgcatagtgaatagacccaccgatacagagaagctaaacaaacaaatggtttccacttactgggtttcaagtctaagaaaataacaaaaggtgcagtaaaatgtttatgcttaaagattttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatagaacaaatatataaaaatacatgaatatgtaaatggcacaatacagttagatgaacctatacacttacatacttacagaataaaagctcacataaacaaaataattacatacatgatgtatgacaagtgtctacaattagcattaccattttgaataatagaatattgattaactgatagactgaacaatgagttgatgcttatttatttagctccagcattgtaagggggataagatactgggtcacagtgtggggaaggcttccttgtgggtcaatttaatcccctcaatatccctaagaggaagctattaccccaattattcagacttctattgatagctccattttacacgtgatgaaaccaaggatcagaaagtccatgtaacatgcctaaggtctctagctaatacctggcaggataccctacatcttgatctccagtgaagcctattttgtattgggagagacagacaataagaaaatatacaagtgaataaacaataaattcctagatgatgacaagttctatgttgaaaataaaacaacctaagaatataaagagtaactcagaaggggtatatcatctgtgatggttcaggaggaccattctgaggatgcagggagcacaacagcatgatgagaagatatggggaaagagctttctaggaagtagaaacagcaagcacagaggccctgaggcagggaagagctctgagtgtttgaggatcagcaataaattcagtaagactgcagctgagtgagcaaagtcaagcgtgacagtgattaggtcaggaaatgaggggggagcaagatcatgaggtctttgctttccagagcaaggagtctacagcttattataagtggaattgggggattttagttggtttaaaagagaaaagtgacataatcagatgtgctggatagggggatgtgttgctttcaaggaaagtgctgctgaaggcctcatgctctccagggagtgaaaccaattgctcattcctacatgtgaggttgtggtccacagcactgccttcagcagacagtcagatgtcaaaggaccacttctatccaggcatatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaaccactttctaatgtaaatagtagctaaatacaaaaacatcagggagaaggctgatcttaaacttagtatggatcgtgcaaaggttaatttgctaatatcctatgagcaatgaccagtccactttgggactctggtagttcatgggatcaaagatcttcattgcttttataaacctaatcccgctggtaagaagggaagtaacagttcgtagtaatggtgaattatgtcttcctagctactacagtaccatctaccaactggatataaaaagaaaagagtttcctctacaagaaagtcctaaggtctatgtggccttgtattcattccttaaccttataggggatggacccgcagatctgagtcctcttccagttttaaatccataacttcaaaacattcaaatccatacccaagctgattctacaatgccttatagaagccccttttaaaaagtcctttgacccaaaacaagctgtggcccactggccaaaggaaaggagagggatagaatgatgtgaacagagagaacataggcaagccgtgccacaacacagattttcagactcaagcccttcaagattggctgatcttgcccttcctatgcagataacaaactgagcccaaacagaggagagcaactaggtcaaggtcaattgacttttatgtaaaaagccaaaagtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacatagaaactggcttttcagctttccttgcaaaatcagatagggccacattggcaccacattccacatgctaaaagggagtgcagctgtgaagcacttatccctctggatgggatgtttgttctccaatgtgccacagttcccaccactctctattgtctcagatggcctcactcttcattctttcttgctaactgcctgaaccctataggtatctaagtttttaatccctactataataggtatcctctagatattgcaaaatacaaatcaagtataatacaccatgatttacactggaagcaagagctatggctccctctgtgagtgttcaaatcacacgtttctgttagatcctgccacagagagttggccaatgtcacaatcctgggcttaaggactgcatcctgttgcagagatgcagcctctgttggaggtgtccattggggaagagcagagcaaggtgaatgaacaggggagctggtgtggtaatcacttgtttgcttatctctcccctctagactgagtttttcctgtacaggatgcatgctttgcctcactggcattttgcaaagttcaaagagtaagccttcagtaaagtctggataaataaatgcatgtatgaatggggagtagaatctcatgactggctggagggatggagaaaagataaagtggcaaactaggaaagtctatgcagagaaagcttggaagtgagtatagaatcatgaaacaagctgcttcttagcttgtcttatttgttagaagcagacagatgggaaaggaaggatacagaaggaaataaaagtagtgatatgctctgggaatctaatttttgccttcaatccacaatgccaagatgcaagtccaattctaagatacaacaatttgtccttgggaccttctagagaccctcttatacccttatgtaccccttacactcccaagaatatatatactttcagtatacccagaactgatgttctctggttaaacatttacttgcatcactcaacaccattttttggtaaagaagaatgagcattagccatctaatccttattctaattctgcctttactcaacttacagtgtttcaacatatacagaattggtgtgaaatcaggaagcagggtgaggtgaggtaaggggaaaaaaggaagtaagaaagccttcacaatgtgataaatgggataaaatcagccataagctagcaataatttaattattggtttctaaaataaaatgccccagtatgtccaacgcaggaagttgttgctggttgcaaaaataattacaggggaatagaaatgacttcttttttcaagaaaaaaaatgccacttgtcacaaaaaggtcttaagccagcaatctgcaataaaactgttataataacaagttagattgctttcttgataattattaggtaaaggtctaccaaatttgacaacgacattatacaaagcccaaccccccttttttttttttactgccaacatcatctgttaactacagtagtttcaacccagatgttcctgaacaaaggctcttaagaattagagtccaactgtttctgcctacccagagggaaatacattgttcctgccattaaatcagccccctttactggaaacattacttgctggtgttaattaaacatggaaacctgtcatagagtttgcaccttcaggaagaaaatacaaagaggaggtttggggctgttgaagaggactcaccccacaagtcaggtgagggaggatgaaagaagcaactgtcatcattccccctgaacccaaccccacccaaagcaccagcccctcttcagctatccagagggcccctgggaatgtcaggttggcacatgcaattgaagtagatacggatacaaacactgcacattgggaaacaaggtcttctggatcgaggggctggaatggaaaagattcacattcaggagctttaatttaaaatgacagccgctagaaatcgaaatatccaggtaaagaaactttgaaacatccggatttccaagactcagcaccaagaaaagagaagtgatttaaaatgttcatggaaatgttaagactctttttctctatgaagctttgataggagtggagtgggaaggtttcagaatatccccaccctctctcccactctcttattctctccttctctctctctctttcacacacacacacaaacacactcacacacacacaatctccactagcacacctaagacactagaatttataaatacattacttgatacagacaattaacttttgcctaaagtgtgaacaactgcatttttagagagccttgctattattattaatgagaaacataatatgaaagaaaaaaccatgtgtttgctacaagaacccagtgttgagtcaaagcccaagcgtccaccccatttccaacaggactccttccctgacccttctgtagagaattctggacccaccactgcctcagtagcctgttattgaggatttcaatagactttagggtcaacggtttattcactagctcatagaaggtcacctcttgggtctctgtagtagaaataaccaccaatactgtattcacatctctattcatatatgttcaaccctaattacaatactccccaatcaagtggatgaatagagccagttctgtgaggggaaaatattttttaaaaaatgagatctgccaggtgcggtggctcacgcctgtaatcccagcactttgggaggccaaggtgggtggatcgcctgagctcaggagttcaagaccacccagggcaacatggtgaaaccccgtatctactaaaaatacaaaaaaattaaccggttgtggtggcacacgtctctagtcccagctacttgggaggctgaggcaggagaatctcttgagccccagaggacaaggttgccgtgagctaagatcacaccactgcactcgagcttgggctacagagtgagactccatctcaaaaaaaaaaaaaaaaaaagagagagatctgagcctctccataaattcacttaaaatgctcatttttgcagccaggctaaagaaatctatcatataacaattgggtctgcctggtttctgctccatgttcaaatttggatgtctttctccaaaaactaatgatttcacagaactgaagttaaactagctacagttttcactgggcaagaggcccagctttcgccgggcggtcttaaattttaaatttccccaagcggcttctttttaaagatctgtctgtgcaaaataacacaggttgagagcatgattttctgaatttaggaggggagcactgaatgcagggaggtagaggagggaaaagagaatccccctgcactcttaaaccagcacagtagcatccatacttgcccctgggcttggggacagaactcctgcccttcagcacagctgaggaagatctgattggagttccccaagttccccaggcattaaatactccacatcaaacctgaattttaactgctccatcagctgcagagggacagagagagacacataccatattttaaatacatcttttgtcctaatcccctctgagctgtaaaacctgatacaattaagcttttatattttgcaaatgatgaatgactgactaataggttcccggtgagattcagaacctagaacacagtgttcttgaggcagcccaactgctgaacccatggtttcctgcagctcctccttgtccagcccctcccctcccctctgccctccctgggggtaggggagtgcaccctcgctttcgcaagtgctcaccaaaaacactgttatcagtttcccccaaaaaaatcacaagtcaaaataaatctgatgcatctctttgtctcatctaaagaggaaagcaatttgctgtaactggaaaatctcggagacctaggtgttgagagagctccctatggtaccaggtggcgcagcctccagattccctaccacttagaatgtcctcttccttctttatcccccatctgaatcaaaactcccgacaagacacagctcaaatgtcatctcttccaggaagaacccccatgtccccccagcctacagggagatgtccctataactctcagcatctctattccagctgtgtgcatctaccacagcacttatcagtgggtgtctagatctctctgacgatgggtactatttcccttagccagacagtaaactctggaggcagccaccctagggaaactgaatattttacttggcatttgttggcatttgtaagtattgctattaatcttttcatgcacatatatttgatcaaatctagtagcagtttcctctagaagtggcaccaagcttggcacaatggtgcacatatcccaattcattaaatatctgattaatcggtgattaaccgataagagaatttcctaaaggttaaaagtaaatataacttggatacacatatagctcgcaatgtgtttctttctttctaagtgcttctattatattcaatgagaaagataaaggtagaaggaaaaggagaggagggagaggggaaaagacattaacccgtactgacagataagtcatagcactcctatttcagagaaggagattggagtaagcatctgtgatggttaatattgagtgtcaacttgattggactgaaggatacaaagtattgttcctgggtgtatctgtgagggtgttaccaaaggagattaacatttgagtctgtggactgggagaagtagatccaccctcactctggatgggcacaatctaatcagcggccagcatggctaggataatgcaggcagaagaaagtggaaggactagacttgtgaagtcttccagccttcatctttctcctgcgctggatgcttcctgcccttgaacatcacactccaagttcctcagcttttggactcttggacttacaccagtgatttgccaggggctcttgggcctttggccacagactgaaggctacactgagaatctcttggcttgaaattgatagagatagctttcggggtggcaggaccttctgcccccactgcctcttttgctctccttcctgttctcttgggaaacaatctcaaatttcacccctacatcctgctcccatatcttttcatagaatgactcccctagcttctgagaaaactccaagctctcccaatcccaccctgcaagggagcattttgccagcctagagaaaaagcacatttatttctttccatgctttaagatgttattggctgcatattgttttagcgcagcgcataattacagaaactgctctgaaaatctgtatattttatctgtgctttatgatacccagaatattccccaattctttttcttcttcgtgaaccagcttaaaatatattttggcatcctttatgtcattttgaaattgaatagccaattcttactgtaatgaaaatacttatgtgccagcccagtgatatacaacactacactctaattacggctgtgctttaattaacctgaattgaagagtgttatcattaaactgctggtaactttgagttatggcttttctttaatttaaagtagaaaacacagataattaagcctccagataatcaaatgcttgaggagagcttcaatgttttgggatgttcctaaatctcattaaatgtccttcttttattgatcatttctacctctgctgtatcattgtattaaacgaataatagcactaagttgtacacattctcactcacatcagaagtggaatatatatatattccagaaactttactgagcaaatactaaattatctgacaacaatttgtctccttcttgggacatgttctaaatacaaaaatcaatcaaagggaatattcacagagccactagtgccagctcttgagctggctgaaggccagtgaagttccacaccacccagtgggtcagggttggcaaactcacacaaccacagggccaggcctgggatttatgtgcaaatctggcctggtttaagatatcagggaggagtaactacatgactatactaacccctttgctacatcaaactggagccagttagcattctgaggaaatgcaggtcttgcattgtcacattagattttctaaagaatccagaaatctagtttttacgtgacatactactatttggaaatatcagcaactagttgatatctacgtgagtcaaacatacctagtgactatcccagttagagcctgtagggggagcagtcctgacccttcaagttacccataagaggaacggactcagttcccaagagcagagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccagggagggggagatcccctgggacagcctcagtgttccaggacccaatgcctctgaatgcttaactcctctcagtggcaggaagagaaatagctctcaaagaaaggcacacatgggagtcacaatagggcatccattttcagaaaataactccttccgaatcaattacctattcacttttccagtccatttagcattaaaactttcgcttagagacagggtgagaaatttcagtaaacagccaaaccattttggattgcttagggtctgggcccagggactgacagagtgcacctgctgtgttcagtgacaggaggctccaggtaaacacgaagccaccaagcgctccgcctccctccctcctgcatacagaaagaaaaccgtgatacagaggaggccaagggcacccaggactgtcccctcctttgtggtaaagcctgatcagttttgtttcgatgtcttcagacctctcttttggtttgtatgtaggcaggaagtgcaagcaaatggcttttcttcctcagcccagtgagctcccagatacccctgtttcttcccagtgagaagaatccttgtcaaatcctttgctaaggtgtcaggagaataggcttaatgtttcaccaacctcagggagtttgtgttttcagagggcacaaagaccccgttcatcttaaactcaacatctgagattttttattattattattttagagatacaatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcaaacatgaggattctaagtgaggaatctgaggcactgtcatgcctcacggcagacacctggagctcttgaggtcatcccccataggtgaccatctattctacctgcagtggccatggcgggtggctttgatccatcctgctgagccagtggaaagagaagctaagacttgttattattataacatggcagttgtctatgtgggggctcaaggcctccttctgtatatttggttccacatttcctcagcaaagggtgaaaacactttgaatggctttatttcagtagcttctctgttgtctctatgatcagacttgatgggaagacagattaaaattcctttcattgaggggctggcaagatttgttttgccctcttagaatcagacaggcaggggtttatgccactcttcataaatgtgtctacatcacagaaggcatgcaggataactgtagttcataagttagcataaatgatgaattcaagtccaagactctcaggcctgtcaagaaaagtggggccagtggaaattccccaggcagaggccatgtaatgacccaccctcctattcatcacatggggccgagcacacgggataccctcggcaattgtcaagtgctccaactgtacccagcagaggtgggaggcttccttgcaaggggcacattcaatatccctgaaagccaaagagcatccagttaaaggtcacttactcacaaacagtagggaaggacagacccacgaaggcactggagagatattctgtgtacatttcatttgagactccttccaagtagtatttctgccatgtgtcttcctcaatctaaaggaaaggaacacatgcggagagtttaaaatatgacggtgggctgtaaaagggaaacctgagttacactcttaggcaaacaaatgaatgcactggttagataatggtgaccttttcagcaatcaggaacacggcctctgcacccatataaagccttcaataaccctaaactcataaagtgtgtgccctctaaaacacttttttaacctgtgtgatttctttcctttttcttttttctttttctttttttttttttttttttttttgagacagggtcttactgttgcctgggctggagtgcagtgggtcatagctcactgaagccttggacacctgcactgaagcaatcctcctgcctcagcctctggagtagctgggactataggtgtgcatcaccacacctggcaatttttttttttttaagagacagagtcttgctatgttgcccaggcttgtcttgaactcccggcctcaagtgatcctcctgctgctgcctctcaaagtcctgggattacaggtgtgagccaccgtgcacagtctttaatctgtatgacttctaatggtgcggagacatgggcactcacccacattagtgggcaaggaaattgatacaactgttttgaagagcaattttgcaattattatcaaaatttgtaaaagtacacagtcttttacactacaattccatttgaagtattcatagcaaagaaacaggaaaacagaggtaaaaaaatatacaagaacatcctttctattcatgaaaaatgggaaataaccgtaaatggcacacatacaatggaatactaagaagcaattaaaaattataatgaaaatgtatacctgttcatacagaaattctgtaaaaaggcacattataaaatagtgtacataatctgatcctatttttttagatggcctatagttatctgaatgtttgtaaagccataaaaagaatttaggaagctttatatcaaaacactaacagttgttacctctgagtggtagaatgatactttttttcctctatagattcctgtattgtctgaaggcttttataataagcatgtatatattataatgaaacagtatatttctactttgcacaaaatgacagatttttctgaccccccaaggaatatcacaaaaggtaaaatgttagtttcagagatgtcttgctccaaatttcaaaaggagtatcacaaaagtaaaatgtagtttcagagaggtcttgctccaaatttcattaaaatatgcattttttctaagtagtcaagtttagctggttttcccagcaaccctcttcatgctaggcatctctgaaaggatttcacaatgtagtgaatcttcttttttgtttttttgagacagtcttgctctgtcacccaggctggagtacagtggtgggatctcagctcactgcaatctctgccccctgggttcaagagattctattgcctcagcctcctgagtagctggaattgcaggtgtgcaccaccatgcctggctaattctttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctaattcttgtatttttggtagagacagggtttcaccatgttggccagactgatctcaaactcctgacctcaagtgatctgcctgcctcggcctcccaaaatgctcccaaaatacaggcatgagccactgctaccggcttacaatggagtcagtctttagaaactggtgaattacaaggagaacgttgagccgctatgggagcttagggatctcacaggcctccctgagggaaggagggcaagctgtgtgtctttggctgcagcctctcaggcttcccttccagtgggggcatgggtaagaggaagatgagaggaagccaccccgccaacaggaagtggctctttagaacggcttgtgcttatcttgtattaaaaggcatcttgctggcagccagtcagtcagttcactgggagaaatgcaacatgtggaccagaaggagagctaggaacagtgggcaagggcacacctaccatctacttggtgacactccagcatacaaaagccagaaaaaatttagaaataaactgaaggctccctggctctgtgctctttgtctgcttttagctcagtctgggcaattagattatgtaggttaacctcattagtttgagctgcttccagcctactcccacaggttagacattagctaggcagtgctgctgggtatgagcagtttatctacaaattggccttccccagagtggggtctttaaaaaaaaaagtcactcaaccaattctattgctaaatggtatgattttaaaaattaactgcaatgtgtttagctaagcctgaactttttaatttctccaaaccataagatctcaataatttttttcgaataaaagatatgcttgacttataagcaaaggtcactaactctaactaatttgaagaaagcctaatctgccttagtaaaaaaatgttggaatatagaatatttgggaaacagtattaacataatttgttttattaatgaataggatactatatgaggtatcactaattacaaatccccatactagagccttatgggcaaatagtattcctgaagtaaaataattcagcctattcttttcatatgtgttcttttataatgtgttgtttatggtctaatttaaatacaacaactgattatcaaaaataatgaaaatacaaacctttattattgatcattggtggtattcctcaattaatatggttttaacaaggttcttttagttttggtcagaattttcatgcctttatgtcctaatgaagctattctttataccaaattttattgtaggtgaatcactaaactttttaaataagaaggaacacattttttgtaggataacaatattattcatgtttgttttgaatttagcaaaaattgttttattgagtcattcattcagcaaatattgactgcatatatttttaatcttaggatctgttctagcttctgattaaatcaaaactggtatttacttccccatatttttctctttgctagagaaagcaccagatgtatctgactatgatatacctgaccacatatatctgacttttactgatttttccatatcttttttcctgcaagtttgcctctgtggctaatcaaaatgcttgaggactgaaagtcgtataactggaaaaaagtacagaatgttctagaaaacaaaatgcctcttccacatccttgtgtagacctgcggatagtctctacacactagacctagtagcatcgaatcaactgaataaatgctggagcatttaaatccgttgccattgccatctgtttaagatttccacatctttaacactatttccatatggatagtcaatatgtttttgaggtttctggtaaaggaatttcactttaaaaagagtctaaaattgctaattgaattacactgtcatattctcaagcaatgtatgtagttggtgggaatgtaaagtggcacagccactgtggaaaacagtatggtggttcctcaaaaaattaaacatagaattaccattggattcataattccacttctaggcatatatccaaaggaactggaagaaggatctcaaagagatatttgtacactcatgctcacagcagcattagtcataatatctaagaggtggaagcaccccaagtgtccatggacagatgactagataaacaaagtgtggtaatttacaatggaatattattcagtcttaaaaaagaagaaaactctgacacatgctacaacatggatgacccttgaaggcattacgctaattgaaataacccaatcaaaaaaggacaaccgtgttatgattccacttatatgaggtacctagagtcctcaaatgcatagaaacagaaagtaggaaggtggctgccaggggttgcagggagagggaatgaggagtcatcgtttaactgagacagtgtccgttttgcaagataaaaagagttccggaagtggatggtagtgatggtcacacagtcatgtgaatgttccactgaactacatgcttaaaaatgattaagatagtaaattttgtatgtgtattttatcacaattaaaaagatttttaaaacccttatgtataacataagagcaggagaatcagtaattataattaatactgagaccatttaatccttaagtcatgccagaacaaggacacgaataggccaatcacatcagacaagtcaggagtgagaacccagagtcattacatcatagtgcatcacaaactcagcaacagaacttcagtctttatacctacccaagggctgaaattatcaccttctatcaaggtaacttttctaagtctcgagtgtggtatctttgacttactttggaaaagcaaaaacaaaagtgtacatttctcatacaatgcattcttaggacagaaaaaaaaaacagtgtaaaatacattgaatttaaatccttagccacacctgtatcccagcactttggaagctgaggcaggaagtttgaggctagatatttgagaccagcctgggcaacacagcaagaccctgtctctacaaaaaattaaaaaatttgccaagtgtggtagcacacccctgtagtgccagctactcaggaggctgaggcaggaggatagcttgagcacaggagttcaaggctgcagtgagctatgactgcgccactgcactccagcatgggcaacagagagagatcctgtctctaaaataaataaataaaaccttgtgtttaatactaagaaaatgaaagtgaacaaagaaatctggaccaggtaaagggagttattgtcattatgaattccccttttatagatgataaaactgaggcacagagaggttaagaaacctgctgacagtcacaaagtgaatccgtggtacaaacaggattcagagttcacactcttaaccacccaccacaaagatagaggtgtagggaggttgtggtgttaggatttcggggaatggggaggatttgctgtgtacaagtaccaaagagggaaatatcaaaaccgaagcccatcaaggactcaaaagcccaaactctgtagcctatgactttacgagacgtctagcaaggagtaataatccattttggctctagctgaaagggcggttcaagcctcctctcagagcataaaagtatggtttctattatacaaaatggaaacttcctagcctacaacttctttcctaaaatagtacatgctgttccccacatttgtgttgtcaatgtatttttaactgtaatgtgaagacacacttctcagcagaaaaaaatgaaggaatgggaccaaaatgacttagggaaaggtgccagaattaatttgccagccattcagcaatcagtcaaaggcagagcatttcctgaggcagcaatttatcctttggctgtcacatcaaaccccagctgttttagaagagcgcctagcaaagatgagcagatgatgctctgtgggtccttattcatcaaatacacacgggatcatcagtgagaacaggggactgagccaatgaactagcttgcctacacctctcatttactgtcttatttatctactcttcattatctaatttttcatccagtctagttgaacctcccaagcaaatggtttcacaccaatccacgggcagacagctcccccatcaaatgtaccttccaactggaaacctcagccttggctccacgggaagtcacaccttcctgatcccaggttctgtgtgtgtcactaatggtgggttggtaatgatgccttttattttttatgcttcctctgattagagtgaaactgtgtttctctaatgctaacagcccagtgaatgtgaaaaattcaactctcctggctgggagtatgttacagccatcatgatttctgttcccagtaaaaagtctgaataactgtgttgattacagccaaataatcttgcaaaagtccacctctacccgtgaagtcatgtaaataattccaaagattgtcatatactagtccttatttaattgaaaacaggcaaattcttttaatccaaatatacattatattatgcacatcaaaaataaagcactaaaaggaaattataaaaaccaatgaccattatgttaatagctgcaataagaagagatgagtcgtaacatatacacactaacactgcccaaaacaggtagtagaaggttagtgtattcacaagaacttactacatttactatttttaaaaagtctatctgaattttcagtaaatattcttcctataaaggatccacagttttaaatcttagaagtgcttaataagaattagagacatttgaatgaatatttatatatatcaattatgcaatacattgtcactgtcctttataataagattgtctgaaacagaatgcagtcatatgaactgactggcatatcttagatgccattaaaacgtatttatcatgaccccacaccccccaagaaaaccccacaaaatgtgtcaagtccttgcctacaatactaaacatgaaatcagaattgatgggctctaagttgatgaatgtttgggctggttactaaaatggatggggggtcatttgtatccattcctcaacagcatgctctgtcaaggggaaaagtttaattgaatcttgcgttttctcatttcttgctgaaaagtacgatgttaaggccagcaaggtattaagaagacttcatcatgggacttgtcagattctctcctcctctatttccctctatgttccaatgtcaacaaacttgccccagtttttatcaaagggcatgtggttatctccttctctaccccttcttagcctcttcgttcttcagtataattgcaaatcctaaaagcaattcatagaataaacaaaatgaaatgtttgagtcttgttagctgaggtccaaatggtgccagcacagagaatgcctcactgcacagctttctggggtggagttaactagtgatcaagttgaagccaaaggaagaaagcagaagagaatagtgatttgcaccttttcagaatgtatttcttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggaatggacttgagccaaatctcttactcccagaccagtgggctgcagactatcaaatgagatttcttccatcaggcattatgaaaaagaatcaacccacacgaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagtgttacatatgtggcaggaaactggtctttttttttttttttttaacacatagaaggttttgccaccctatcctcaattttctctccaatatagaaaaggtgtttacacttaagagccttttttaaagattggcctattcactctctgttcagagaggaatttggttttgcaaccttgctaatagtaaagaacatatttacatgtccttcaaataataaggattcttaaaaataccactgaaaataattcttatttgggtaaattgagcaggaagtaaatgttttcagtcagacgtctgccaaaccaaccccagaatagttcagcttcgtatgcagggttttcaggacagcccttcttaccccatctgaggtgagggaccagggtttagcttttatttctaatatccattcttttgcaaaatctaataaaaatgaattacaggccaggcactggctcacgcctgtaatcccagcaatttgagaggccaaggcaggaggatcgtttgagcccaggagtactagacctgtctggacaacatgatgagacaataaataaataaataaataaataagaattacaaaaaaatgaaaagacaaatccaatgcaaggtacaaatccaaaatttttatcatagattcacaatccatataaaattaatccatccaattgctttgaaagtttctaagcacttactctcatcttctgtacttaactcgtcacggatgagtatcaaacagctcacagtccccatctatggaccatggaccacacttggaattgtgctggtccacaacatggcaccactctgtcttaaaaatctgacttcccataatttcccctgcttcagaaaagcagaattgttctcaactaatacttcacagaaagaacttgacaaaacttaatagcaggtgttatctgaaacaaaggagaatggggaggggattctgtggtggcccctactagaatgtgggaaatgttgaaggcacagatttttacctgaatctccactgcctggaactgtgcgtggtacatagtcatagctcaataatagtttctgaatgaatgaaataaacttgggaagcacagaatttaacaaagccaacttgttttatttaattttattattttactttcagcacaatactccttagagtatttaacatgttaagaggaattgtaaatctccaagaggagaacatgacttttttgtttttttgagatggagtctcgctctgtcacccaggctggagtgcagtggtgcaatcttggctcactgcaagctccccctcgcgggttcatgccattctcccacctcagcctcctgactagctgggactacaagcgcctgccaccacgcccggttaattttgtttttgtatttttagtagagatggggtttcactgtgttagccaagatggtctcgatctcctgacctggagatccacccgcctcggcctcccaaagtgctgagattacagacgtgagccaccgcgcccggccagaacgtgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatagtaactgcacacatctctcaggaggccatgtgggctgaatgagatgatcagtacagaatgtctagaacagtacctggtacttagtaagtgctccatgtgtggtgattagcattaagtaccatcacagcatttgacttctctgacatctgaagagaactacaatgaggtggaattccatttccgtatcgactgtaagctccttaaaggaagagctgtcttactcagctctgtatcttctagaaggagcagcacagtactttgcaaataagaggtgctgggttaatatctgctgagttgaactaagcaagataaaactggagagagaggcctaaagaaacaagaacaatttttctaggcatctgatcataagtaagcatgaataacttcaataacttcatagcgtttagtgttggggcatgaaataaatcaattctgcttctgagcatggaaaaaatttctgcactgttaggatctaccagggagtatgtataactgggtcatttttacacttcccaaaaaacttcttactatgagcaatattttctgggaaatttttcattacagaacatcttgggcttcttagcaactgacttacggttttctaaattctaaatccgataacttggaggcttgaatttgaaagacaaaactctcaagaactgatatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaaaaaaaaaataaaaaaacaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtcacccaagtgtcttggcaaaatccagtttctcatgccttagtcctgaggtggggtcaagtctatgagtctgcatttctaacaagctcgcagatgacactgatgcttcccctatagggcccacattttgagtagcaaggagctgttcccaaagacggtgaagaataaggggcaagtattctccatgatgccttgaggacaagagattcagaagaatcgattacagcctaaaggatttgaaccagagatgaaaaagaatgctttccatgaagtattgctagatattggagccagttacagagaaagcttttagacaattaagcacaagatgggtatccaagtgtttgggctgttgtgataattagcctaaacaatatttcaggggtccagatttatctacttagtctctctccattgattcagtgaccccagtaatagctgaatctccattggaatgtgggttgtgtagatacagaagcaatatcatgactatattgaattcaattaaaaataaagtttcagaaaatggccctgatttgcatccctaatttctattcaactttcccattttaggacacagtattgagtgtgaggacgaaaacgctcgccaacccagtcctgttttagtgacagcagattctgggtacttatgtctcctatcgccatacaatatggcctaataaagtcgcgccaaagagactagatttcatttcagagcaaagggttcagtcgtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgtcagttagagaatattttcacaggaagttagaagcgatttcagaaattcccctctgcagtttctcagagtggatgttaggcctcatcaaaaagacatttggttcagagattgaaagtgggcagcctataaattgctgaggtatttagctgggcttagcagttttcctttgaggaggaaaccatgatcctgagtgctcactgagtacagcagggaagtgcctaagttcacgcagcctctggcttcaaaaaatcccagccttatcatgtgctcctgagccaaggagcataacctctccaagccttaattcccttcacctgcaaaatgagagcaacactagtacctacctcctagggaggcagctgaaatgaggtggtgcatgtaaagtgcttagcagggtgcctggcaaatagctaacatttgtggagtactttctatgcaacagatgagcatgtgttctaaccatactaagagatggcatttattgagtttgtaccttgtagacagtctatacatgtcagctgtcattataagtaatgagtgatagtgatagtgatgatgctgatgatgctgatgatagacaagatagctctactgctcagacaaaggaactatgccaattagatgtggggcctgtgattcatggcttcctattgcttagctgctgctagaaaaggctggaacatcagtgatcatacagtggttctctgaattgaagagaaacattaagcagcctgagtttgtccccaaaagacagcaatattctctggaggtcctctctgccacccatggactttcctaacggccagtaagttaactctgggtagatatgatgataagggagaagttgatattttgaggggacatgatggtctcccaaaatagaaaatggatcatgtgtgggtagcaccattaacatgatgcaggatcacccagcctggctttctgaaaggagccctgggcaaacaggaccctgatgaccagaatgacacttgcccacatctctcagttagtactccccacacactattcgtacctgtcgttctccttcctatcaaatggctttgctactcacttccagccttgcctccacgactgattttgaatggatacctagcatatccttggtccacaggatgagtgtgcaaaaaaaaaaaaagggtacttattcaaaatattctttttaaaaatacttgtccagcttgtatttggaggacagacagagcagtagatggggtgatagagagaggaatgatccctggtcagagtcttcagctactgaccctagtaattcaatcttgagcccaattttgcatactcagcaaaagaaaagttttgcagtcaagcagacccatgctttttagaaagcaagttataaaatatctgtcattacttgaacatgccatttgggaggaggagactcatccctcctagccgaaaaaccgtatcaaagtattcccccaaataccttattaaagtattcaaagtaatctcaaactttctgcctcctgagaagagttctgggaagcacacttttctatttcttgttgcatttctagaatgttttaccactcattgtagttcagcatccccagaaaactgacaggcaggccatcaccctgcagttggtataagatggaaagagggagaggacttgctatgatcctgtttgggcaaagagacccctccctgtccccatgctcacctgtcccatgagcaagttcaagtcaataatacatgtctatccactgaggtaactcattgcagcacacagctgttctccttgcagtcaacaccagtgcagagctctccctgggcaaagctgcacttgctggatgggttttcattaacatatgggaaagaatagtcagcaaatcttcactgttgcagaggactgggaaaaaccagacagatgcacctagttctcacctatccatgcagacaaaatcatctagccttagggagtggagggtgaattgccagagacgctgaaggggttgggaaaaccagtgtcatttaggttgatgaacaatgctgctgccctaaaaaatgtattcagtcagaaaattctgctgactccgtatctcaccacaaagagctccagggaccttccccgacatcagtcatttacaaaagtgttggcaacacaaaattgtaagcactgtaggtagggatgcctttatgccaccttagagggtggttttatatcaggattattcctctatcttctcccatcagtgatccagttctgacccagtctcaaatctcatcacaaatagaaagccaaacagcacctacctccatctcttaagaaagttgaaggagagaatttatagactgaggggtaggtgctttcatatacggataatctttcaaaaataccataagctcttccattttttttacagcaggtaaatagggagctaagagaggttcagtagccttccccaggtcttacagcaaatcgcgtcctaatcagagtcttataatccttgccctgtcccatcctgctgcccactgcacagccgcacaacccccctcacacttcacaaaccagggataacaggaagggtgagggctgtggtagcaattttggataatatagtggtccatgggtacttatagcagggaaatactatctgagatcttcagatgatcaaaattgaatcctagttagactggaatacccaatcccattctgaaggggaatcaaatattcctctttcagttgttcttgcctctctagcctatttaaggagaaagagaaaaaaaatactcaaccacagatagaaatgtccttctcattgccaaattttagccaaaacaagaaatcaacagaagcttcttaagaaactatacctatttgtcccagtctagaaaaaggagaaaggatagaatccatcaccctaaaaagcaatgccacaggtatgggggccaggaataaacagacttccacagccagactgacaacaaagagcttctgcacaccagcatcagtgggcacagagatatatgttacttctcagtgggcagagataccctatctacttacagggtatggaaaaaagagaggaagtgatgactcttattcatagatattaattagttacatccacttcccatcctccagtgtatacagagtacagccatcaagacaggacccctgtatttctccgaacatgaaaccctaatcactgggactgcatcactcgttaccatgaaatacatgtggcagttaatgataaaaaccacaaaaattacactcagttcaaacgttttattgcatgccattcttcaagatggcagatggctgcctaaattgatctcagtgtcatgttacaggtgcccctaagtttctctaaatcagccaaatgagtttgaagttgaaacggccacctcacattgttctaccaggagacgcacaggatgccactgtaatgcagtttgctgaattatagtattcataggctctgattaaaaaaaaaataggtgaactacctgaaacttgccccacagagaatgattattgaatatgctaaaaagccatgatgctgatgaccctgacttaaaggcaatattctccccattctggctgtacagggcaaacatagcatatggcggctaaagagatatctgagttactggttctgggtaagatggagttatcacagttcatcctgtctttcccactgaatgatgttctaagacctggacagaatgcatggagcagctatttgaagacattgagaataaacaatggcaggtagattgaagaagacccgaattagaaataccaccaaatcagcagtgaatttaccattgttctcttctggtatcctctagcctgacctcgaggcagccagaacctggaagggatcatcaagatgtggacaaaaaacctccaggagaagcctcatagtagaactaactaatgcgaggtaactcttagaaaaaatggaggaaatcactgtttttccctccctccctccctccatccattccttcctccctctcttccttcctctctttcttctttcctttcttcctttctttttctctcctcctgtgccccaacaccaagccatctagtagtggcagtagcagtggtgacaatgcaagccagaaaaagattaaaggagataggagaattttcctctctgcccaaaaaacctatggtcctgagagaatgaaaaccaaaccctattgctttttgtctctctctgcccttctaccagttggccccagatgtgaacacaatcacagaaagtatacagaaagccagataactaaagcctcagcagcccttccatcaaaagatcaaaaaggaagaccccagggaacctgaaaatattgcagagatcacatagaaagaggacatggggaagtagtcactaaattgtttataaactctggggctcacgctaagctgtgcatggatgaaactgaccctacacagcacatttagattctaagaactaaactacaatatagaccaccacccagtctgagggcaatattggacagatccaaatagcactgccaacgctttgaaaactcaactaacattgaagtcacaacccatagaagccccataagaacctgtagcctaaaatcaagccgatcaggccgggcgcagtgcctcgtgtctgtaattccagtatttgggaagccaaggcgagtggatcacctgaagccaagagttcaagaccagcctggccaacatggcaaaaccctgtttctactaaaaatacaaaaattagccaggcgtggtggtgggcacctgtaatcccagctacttgggaggctgaggcaggaaaattgcttgaacccagaaggcagaagttgtagtgagctgagattgcaccactgcactccagcttgggtgacagagtgagactccatctcaaataataataataataacaataataataataaagtaaaataaaataaagcaggtcattaccttccaaaataaaattatcaacattcttacaaaatttaaacaagaatcagagtttcataataaaaaaattaaaatatccaagacacaataaaaaattacttgccataagagtaaccaggaaaatctcaacttgcatggaaaaagacaatcagcagatgccaatgcctagatgacacagatgttggaataatctgacaaaaaccttaaagcaactactatttcccgataactaagaaagaacacatttgtaaagaagtaaaagacgggatgcataatttaaaaatcaaaattttaaaaatcaaatggaaatactacaattaaaaaatacaataactaaaacattcactgaatgggctcaacagcagagcaaagatgatggagggaagagtcaatgaacttgaagctaggtcaatataaattgtgcaatttgaacaacagagagaaaaaagtattgaaaagtttcacacagagcctcagggtcctctgatacatcagaaaaagatttagcatttgcatcataggaatcctagaaggaaagcagaaataatatggtgcaggaaaaaaaaatttttttgaggaaacaataagtgaaaacttctttaacttccccagagacaaacctagcagttgaagaatctcaatgaactccaacaggataaacccaaaagaataatgcctagacacattgtaagcaaacaacagaaaactaaagacaaagagaaaatctagaaggcaatcggagaaaaatgactcattacttataggtaaccacaattcaaatgactatggatttctcatcagaaacaatggaggcaagaagaaagtagaacaacacttttaaaatgttgaaccctgaattctatatccaccaaaatgtccctaagtaatgaaagtgaaataaagatattttcagatgacagaaaacagtgtttgttgccagagcatggctctgaaggaactgctaacataagttggacaaacagaacaggaatgatactaaaaggaaggaaacaaagagaaaacaacaacattaataaatattagaataatataatagactatacttctcttgaattctttaaaatagataaaagcaaaaattataacattgtctgatatagtttgcaacagctgtaatacataatacaactataacataaaatggggagggtaaagaaacctatagtttggtaagggttctacatttcacttaaagaggcaaatcatggaatccaagtagacttaaaaagttaagtatgtacattacaaacccatgagcaatcaattttttaaaaactatataaagaagtataagaaataccacagaccaaaaaaaattctgaaaatgttcaaaatgattcaaaagaagaaagaagagagttcaaagtttttgaaaaattagtctaattttcaaaactgaaacaggaaacaaacagaaagcaaataaaatattaggcctaaatccaaacatataaataataatattatagataaattgtctaatgcaaccaattaagaaagagagattcaaagaatcgatttttaaaaaatcacccgactataaactgtctataagaagatcacttaagttttaaagataggtttggttcaaacaaaaaagaggagaaaagatatacttttttccatgaaaacaccaatcaaaaaagaaagcttgagtggctatattaatatcagataaagtagacttcagaacaaagaaaattacaaggatatagggataatatataatgataaaaaggtcaattcaccaagaaaacgtaacaatctaaagtatatgcacttaacagactttcaaacacacacaaagcaaaacctgacggaactaaagtagacaaatccacagttataattggagacttcagcatccttctcgtagtaagatgcagaactagcagacaggaaatcagcaagggtatagaagaaatgaacaacaccattagccgactagtaataattgacatttatagaacactctgcccaacaatagcagaatatacattctttttaagctcacctggaacattcaccaagacagattacattctgggccataaaatgcaccttaacaaatttaaaagaattgaaatcatgccaagtaggttcttaaccataatggaatcagactacaaatcaataatagaaagataagaggaatatcttcaaatacttggaaattaggcaacacacttctaaataattcatggatcaaagaagtttcatgtgaaattagaaaatattgttaactgaacaaaaatgaaaacacaacatatcaaaatttgtggaatgcagctaaagcagggaccaggaagaaatatatagcacaaaatgtttacaccaaaaaagaagagtctcaaatccaaaatctaagcttcatcttaagaagaaactagagaagaggagcaaagtaaatctaaagcaagcagaaaggaaacaaacaaacaaaaaatacaggaaataataaaaccaaagccgattatttaacaaagatcagcaaactttatatctagtaagagtgacaaataagagagaagacacaaataacaaaatcaagaatgaaagagtggttatcactgcccacattaaaaggacaataatgggatactatgaataactctacatacataaattgaaaaactcagataaattagaccaatttttcaaaaactttgaattgtcacaactcacccaagattaactatttaacctgaatagtcctataaccattgaagacattgaatttgtatttaaaaactttcagaaaagaaaaaaatctaggcccaaacctagtagtatttcactgccaaatactactaaatatttaaagaaaaaaaaatcaccaattctacacaatttctcccagaaaacagaaggaagggaaagatttccaactcattttataaagccaacattacctgacactaaaatcaaagacagtctaagaaacgtacaaactaatatacaccaaaaaacaaacacacacaaattcttcataaaaatattaacaaaccaaatccaccaacatgtataagaaataatcacactaactagggtctctcccaggaatgtatggtggctggttcaatattgtataatcattcaatgtaatttaccatattaacagtctaaagaagaaaaactacatgatcctatacattgatgcaggaaagcatttagcaaaattcaacctccattcatgattgaaaaaaataaaactctcaccaaaatagaaatgggaaggaactccctcaacctcaaaagaaaggtatctacaaaacatctatagttcatatcatacttaatggtgaaagaaatgaatgttttcccttgaagacaggtgacaaagaaaagatgtctactcccactccctctattcaatattctgcaagaagtgctagccggtacaatatgattgccaggtacaaggtcaatacagaaacataatgtatatttctacataccaccaatgaacaattggaacccaatttttttaagatgtcatttataatagctccaaaaatgtaaaacttacatataaatctaacaaaacatgtacagaatcttgatgctgaaaactataaaacactgggtaaaacaagttaaagatgacctaaataaatgaagagaccaaattgatggactggaagatacgacatagtaaagatgtcagtgctcccccaaattggtctataggtttaatacaattccaatcaaaacacaggaggaattttttttaggtataggcaagctgattttaaagtatatatggaaagacaaggacactagaatagccaaagcaattttgaaaaagaatacatttggaggactcaaactttgtaatgcccattttaagcaacagaagattgttcctagaccttgaagctcaatggagtttgccatattggaatctgaagttgtttggttccggtacctcctttcatccttccatattctcccttttggaatggcactgtctatagccattatcctatggctgtcctgccattgcatttggggtgcagagtacttgttttctagtttcacagatccaaaaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattttgcatgtgggatgaatgtagatttttgcagaagtgattaacgatcttgtgataggaaggttatctaagtgggctctaaatgtaatctctattgtctttttagaggaggtttggctaaagaagaagaaataggagatgtgacaatggaagcacaatgttggagtgatgcgatgacagggacaagagccaaggaatgtggtcagcctccagaagctagaaaatgcaaggaaacagattctcctctagagcccccagaaggaaccagccccgccaccatgttgactctaactccactgaaactcagtttccaagttttggcctccagaaaaggaaggaaaaaaacttgtgatatttacagcaactaggtttgtagtaatttattgcagtagccataggaaactaatacatagagtttcatttatcttgggtagatatctaggagtggtatttctgagtcatatggtaactcaatgtttaaccttttaagaaaaactccaaatatttcaacttaaaaacttctttccaggaaagaaagtttaagttaagaaaatgaaaacacaagctacagattaggggcaaatatttacaaattgtatatccaacgagatccaaaatatataaagaattcttaaacagtaaaaaacaaattcaaagaaacaactcaattaaaatggacccagcacttcaccaaaaagcatatacagatgacaaataaccactgggaaggtgttcaacatcagtagggaaatacacgtgaaaaccacaatgagataccacactgcccacctactagactgtttaaaataaaaagtattgacaatgccaagtgatgataaggatgcggagctacagaaactcctgcattgcttgctgatgggaatgataaatggtacagtccttctggaaaacactttggcagtttcttttaaagttaaatataaacttaccctataatccagcaatcctaattcgagatacttaccctagagaaattaaaacttatatccacacaaacttccatgtaaatgtttatatcgactgtattcatgatcgccccaactggaggaaaactaaatggtgtccaatggatgaatggataaacaaactggtacctgcatataagatgtcatactattcatcaacagaaaggatggaatactgatacatgcaacaacctggatggatgtcaagggaactatgctaaatgaaaaaagccaatctcaaaaggttacatgctccatgatgcctttacatgacagacttgaaaagacaaaactgtaatgacagagaatagatcagtggttgccagggcctaggagtgacaggagggtgtgactgtacagcatgagggaatttgggggtatggaaactatcctgtatcctgattgtggtggtggttgcatgactacacatacacaaaatcaactttactgtatgttaatttaaaaaataaaatgaaaaacacttctggaaaactataatcatttccaaatcttactggaatcatgtaccttcagcattttcctataatgcaaatggattactctgctaataaccttgaggacttatcaatccaaagccccaacacctccactcgaattgcttgagttacttgaatatttttgttatgatcagaaggtgtctgtaaacattaggattaactatatttttttctccaagatacttttctttcttcatcttattagcactacctaacccgtccggatctcactcccctttacagacacatttcacacatgggaagtctatcatactgcactgtaacctactgcttccttctttcaaatggttgagactaaactttatagctttcttacatgtccctcaacaaaccagtcatcatctcccttctgtactcagttgcgtcccttggcttgagcaatacatcctcccactacaaggcattatggtctagacaagacagcacttgcctgggtcttttccagactaagctaccaccaagggaatggggcagacatatgtatctcctaccttggaaaagagcttaatttttatagtttttcatggttgaggggaaacctaggataagctcattttacaaatgttgcaaagtggtttctattcttagaagctattgatttgaatataaaacaaagcagtgtttacattcaagacatttctcttggagaagcaatgtgtaacagtggggaaagcgctgagctgagaagccaatgatgttgtagcgttctggccctagctctaccattccccaaccagccatgcaaccagaagtcatcttccgatttcctcctcccaaagagctatggtgatgggtcctgtggcttactattctacaactgaagaaaggtcagagacattaggttctttgcatttggcatgttttccatatgtatctggtttccttgtgtatctggtcaaataaagaatttaagtgaaaatgtatatctcagccaggcacggtggctcatgctgtaatcccagcactttgggaggctgaggtgggcacatcacttgaggtcaggagtttgagaccagcctgggcaacatggtgaaaccccgtctctactaaaaatacaaaaattagccgggtgtggtggctcgtgcctgcagtcccagctacttgggagactgaggcagcagaatcacttgaacctgggggctgcagcggctgggttgctgggggagaggtgggcggaggttgcagtgagccgagactgcaccaccgcactccagcctgggtgagacagcgaaatctccgtctcaaaaaaaaaaggtatatcacgtaaactgaaaagtgctgtgcaaacgtaaagtattactataattccaaagttcttaacagaatacccacggtatcaaatcaatggtgcttccttgttttgcacccctagatgtgtagaatagttgcctcaaagttccaaattcctcatcattgttctggacacagattcacacttaaaatcaccttagggcaacgacaaccaatagacttaaggaaatctgatattttattccttatggcttacataggactttgcgattttcatgtaacaatcactaacagtggatggcactcaaaaaaccaaagtcaaaaatttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggccccatcctcgctgggcaccggactctgtgtatatgttatgtaatctttctgtgctgcctttctctttgttcagtccatgccaagacccatataaaagaatccatatgtgattacagctataaaaccaagaggaaaatattagatgaaaatataacattttggggtttctaagtttgctttacctttaatgctaggcagacagtttacacaaatcattttgctgcaaagtaaagaataatgagttaaatgtgttccctgtcaccatcaatcatgtacatttgcttttgattcaccaaacatataagacacatgaaatgactttctaatcatgttgggggaaggagggagaagggaagaagatggggaaaggagtttcaacttcttttattttattcagaagatccgttgacattttctggcaatctatcttctaacatgctgtatgggcttctttttgctaataatgtttgccttgagaatttgtaaaggtctgagaacgctttaattcaatgttctagaaattaccagggccataggggaaatgaatccctgttaatagctcatggattacttctctctttattagaaatagttttcacagaagttactctactttcaggtgggcattagtgggcttggtcagactgagtggcactgcgggaggcagcatcctgcatggaagcctctgatctaatgggatctaagtagggtgaaaagcgggtacacagtgacgttgacccaaataggatactggggtttagcaaattcatttcaattcatgggtgtttattttgatttgtgaacttaaacaacacactgactggattttctggcagttgaagagctttataaccaaatctaaccagcctctgcacaatccttgtcaaggattaaagagctttgcatttcatgtttctacattgaatcaaagctctttaatttggcaagggaatcatatacagtagcaaagaaagaagttttctgcaccaaaatcacaccaaattacaagtccccgctggtcctggtcccacccagctgtctgtaatacaggctggtcaggctaggctgaggccaaccgatgcattcatttactccacaaacacgtattgagtagctattatgagtcaggcgctgttctaggcactgaggattcagcaagtagccccatcttcacagtgctcaccttgtcccagggaaaagaggcaataaacaccaaagagtgccacgggaaaaaacaaagccaagagagtaaataaggatgtggatgtatggtgtgtggagggggagggggtgcagattcctaaaatgcaattctgttttttccacatggaaacttcatcccccaatgaagctgagaagaacagctgtatacttcctagagaatatgaagtgggacatctactctctctagagaccctcacaagccccagagaacttgtatgagcttagttactttcttcctgattttcctgtatttgccagggaagttgttgaatcataaagtatccctttataagaaatataccatattcatagattggagaactcagtattgtggagatgtcaattctcccaagagaatccagaaacagacccgatcatgtagtatcacctgacttatttaaaaaaaaacagggggttctgggatatttgtaatgtactctttgttaatctaggtcctggttacatgagcactgagggtataagtatttaacaggttgtacatttattacatgcacacttttattatatttcaataaaaaattcatttttaatcccttttaaaaatgcagttctaatgccttagaggaaagactcaactgagaaattaatattaagcaaagacaacaagagttggacagaggggagccaagcagctgctcagggaaggaatatccagccagagggaacaagaagtaaaaatccctagaccagcccaagggagtgtggctaacataagaagcaggagaacactcaggacttaagccaatgaggttccagggacctgactgcttaggacctgcaggccattgtagggactttattcagatgagatgggaccccatggagagacttatgcagaagagtgacaggatctgattcatgcttgagaaggttgttctggatgctttgttgaagatagattggaggtggggtggtaagggcagagcagacagaccagttaggaggctggtgtaatattctaggagagacatgatggtggtttggagctagtagtaggagtgcaggtggtgagaagtgctccgattctgggaatattttgaaacttgaaccaagaggatttcctgctgtattgaatgtggtgtttgagggcaaataaataaatttttaaaaatgagtcaagggtgactccagagtttttagtttcagccatgggaaggatggcattgccaatagtaaaatgagcaaagaacaggtttgtggacaaagaaaaggaattcgattgtggaatggtaagtctgagaggagatggggtattcaaatgtaggtgttgagcagcagttgaatcggtgacgccgggttcaggggagaggttcttcatggaaatataaatatggaagtcatctatgtatctaaaagcaatgagaataattgagattatcaaggaagtgagtataattgtattgggagctgctctccactggtgaggaatatgtgcagaagtctgctgtcataatgccatctgtggttagggtgacattgtccatgggtaatagagtaagcaacatcttgcatctccctatctaatttccaccatgtgggtttactttgccagacaaactctctactctggtaccactagttgttctttcctaagtagagagccacctcaatcccagccttatcagttgcagccctggccccatttcagagctcttgtcaactccaaccctgccacgcaaggttgagttctgcttctggtatgcctccttcaacctggttagcagagcttacacccaccagacaataagaattgcttgctgtgatgattaatgttaacttgactgggtcacagtgtacccagatatttggctaaacattattctgggtgtgtctttgagggtggagggtgtttctgcatgagattaacatttgaatttgtggagtgagtaaagcagattgctcccccaacaaccctcaacccaacccatgtgggtgggcttcatctaacccactgaaggcctgaatagaataaaaaggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacacacacacacagagacaccattgctctgtttctgtagagaaccctaatatacttactttgtcccagaagcacctacctaagtcatccccagcccttcagctccacttggtttagactccaattagtttcacctcctcaaaacagcagtgtgtgtcaatcccttcttgggagcctagttcattccttaccctgactcagcccagcctagggtaactgttatgatgcagtggcctctgcttttgcagagctgggcagacagaaaggtaaagaagatgcacagaatggagctatgcaaacatgtgcccatacatccaagtcagaacagaagctttctgaagcttaccagagcttcctagacctaaggatgctgatgggattagcgcactgtctggaacatggtaggtccccagggcatctctattgcatcaatagttcacatagaatgaactatagaaagctaagatttgtgctaagatgatggcactagctaaagttttcccttatcgtttctcacatttcctttcagtatactcaagggcaaacctggaaccagtttgcttgggtttgaacacctgagtttgtgaattccaaatcacacatccgcatgcaggttgttgaaattctcttaacccatagtgcctgccactgtaaaaggaggataataatagtgacaagtttgggtatggtcattgtgagaattaaatgtgatattgcagctaaagcacttaatacgggatttagcacatgggaatcagtattttttagctattattaaaagtccttgatttacatttttagctgctaaaccagactaattctatacatacatatgtacaagcacacatatacacataaacataacccagactaaaaatatttaaatgattcccttggctatggttagtgctaggacaaaaactttgtgtgtccagccatatccacttcagccaagatacaatctgaatagcatgcttctgatttctctagtgcattctcattcagaaacagaaaacatgacagagaagcgtgtattgttatcgatattaagtaacatttcacccgcaaattccaaatcttgcggcatagggaaaaaaaaacaacactagaaatacataacatattttcttcattctcaaaactgatttattcaacaaagaaataatcatggagagcatactgtgttccaggttttgtgtgtgtgtgtgtgtgtgtgtgtgtgtgtgtgtataaaatgatagattaacagacttcaaatagttggcaattctgagaactatttaaatgtgctacattggaagtcccaatgtacattgaaaaacaattttaagagttaatcaccctctaaacacacacacacacacacacacacacacacacacacacacacacacacaatttgtcatgtgcaaagacagctaatcctagtaagaatgatagcacaattcatgaagatggcaggccatgccccaacttgaaacctcatacgctgaagagaagctaagtatgcatagtaagactcaaaaacaaaaacaaaaacaaatcaatggatcttaaattacatccaagtgaggaagccaagtagagagtaagtgtggccacttattcagggctgaggcaatagcagataggctaagtaagttcattgcctgggtctttacagaagacagcagggagagtctcactagaacctgacaggctaggagtaggagatcagacagtggcaaatgaacagcatgttccagggctggctgatgatgtgaatgcagataagtcacaggcaccaggatgttcgtgcgaactccttaaaggaactcaagggttcaaataagatcctattgcacaaaatgcttaacctgtccttaacagcagctgctgagctggaggatccctggattgccagcttgagtctctttcctaaaggtattagatataaaattagcataagatttgttaaatcctagcactgcagaagctgtagagggcatgccttgaagtttaaatggagtaaattaaggacaaatagccagaaaaaaaatatttagcagtagttagcaaagttaagaaattcattacccccaaagatatgggggtatataaaatataaaaaagattcctaaaaagtttagatcaattcagagatatatccacataggagtgaggttttcagggacaaagacttagggtcctaaggttggtatctttgagagtggcattgatggagagataaagaagcattgctccatatttcttggtacctccaggctgggcctcttttgtaattcctgtatgccagtagtccctctttctttttctttcttttttggagacggggtcttctttctctgttgcccaggctggagtgcaatggcatgatcttggctcactgcgacctccgcctcctgggttcaagcaattccccggcttcagcttcttgagtagctgggactacaggcatgcgccaccaggcccagctaatttttgtatttttagtagaaaagggatttcaccatgttggccaggctggtctcgaactcctgacctcaggtgatccacctgccttggcctcccaaagtgcttatattacaggtgtgggccaacacacctggccagtaatccctctttcttttattaaacatatcacccccactttcagtcttggcattttggtctcatgcatgataaaatgcccagtggaagtggctcacacctatataatcccagcactttgggaggctgaggcaggaggattgcttgaacccaggagtttgagaccaacctagacaacacagggagactggtctctacaaaaaattaaaataaaattaaaaagcccagtggatagtcactgtgcttctgcctgtgccacatctttgctgttacagtcttgtttctcttattttaacaggggttctgccgcaccaaaaaacagacacgaccggcctaggggaagggagagggtgagctaacactttaccttggcttccagaaatgctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacaaaagtaagtgagggctttgtgatccctggaatgggagataatacataaaacatgccaaggagggtgccattatggtgttcaccatgacctaaaggagacgaagatctgggatttggaggtaagtacacaaagatagcaatgtagaatggggagcatgtgaataaggcatctctattttagctgagaaaaatatatgaggggaaggcttgtgatttccaggtcatgtaccttagccaattccaacacaaagaccatctcagtgtcaaaaggtcatattcagagagctacttccaaacaggcgggaattggccttatacagaaataatgtggtaacataacccccagaggaaaatgtgttttcagttacaccagggccaggcccagcctttcccacaagctcttcctaaataggaacttggcaatgggattagctgagctggagcggacatccttggctttagaggtgaggcccatcagggtctggaggaaggttgggcagaggttttccctgctgctaatagcactgaagaatcagcatcacatccattttattaatttccttgacagacagctctagttaccatgcaggcaccacaaaatcaaaacatacgcatgtcaaggggccccatctgtggtggggccctgccaaagcccatgttacatcaacacgaggaagcagagcacagctccacacaccatgtgcttggtcccatgggccatgccctggaagaaaaccaccagagcttgattgaaagagccagagaagttctcgtggtgacagtcctttatcctgagtctgggcttttcatgttgaacataagatccctgggagacacgtggctacatctggcttcagggtctcgtctctaaacacagctacacagacctccctgccacctccattcagttccacccatgcaggatgagagcagcctggattaaagaagatacctaaaggaatgcaacatctttatttgtaagctggatctgagctcagagttctgctgagctgagacctttggctgcataatgagcataggaggattttttaaatcaaggtatcccttgctatcagtgttgctaaagtgattgaaggagctccaaagcaatttgttcctttatgtggagcaatgttaactatcagttggctacataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacgggtttgtcaccttgactgcctaatctaagaacagtctaaggatgaggactggagtgactgttatcccaggctccagaagcccccttgctagtggctgggcgatcaatgcaaggctctggaaacacaatcctaacctggcccaccctgggaggacagagtcggttttttttctctccttgcctgcactggtgcagcaggtatggccaccttggggactctggagtgtctgtccagccagctctgacaaggacatgaacacatccagaccgcctgtctctcggtgcaaagggcactgctgccgaggactcagtacattgtttcgctctccattcaaacaaccgcggcatgtcagtcctgctggcctccttgattgtgcagaaataaataaatgaattatgctgttggggtttgggcttcagcacaaacacatggtctgcatttatccacacagtgagaggtccaccagccacttgatataaaagagcaaaatgataattcttttctttaggcgctctgttgccatatggaatgtatataaatcatatttttgttttaacagcggaggctttgttgatagataaacatgtggtttatctaaaaaaagaggggattgtgctttgaacaatcatttaatggccgtggatgtgccaaataaaaataaaaacataattttgaaagaagttggcttcatgcccaaatccgtaacaaggaatttctccttaacccaagtggttagagcccgtcgatctgttttgagtttaagctgtgctctctactcaaccccacgacaaatggaatcccgagctaatgtgctctaataagacgagacgttacctttatgaatgacctcatggagaagaggttggcaagcatggtggagaggccttgagccaggcagctctgggctatgaagcccaacttcaactctgcgaggcagattgcgtcatcaccttctttccaattccagctcgggatgtttagcagatgggcctggggaaagaaaagcaggtatgagaccttgctctgttaaatgttcaattgtttaacatttcttctgggaaatgcagcattgcccaaccactcagggccatccagtcttgcccttcttttcccttgctgcggtctgatgtttgctgttttatgcaactcttctgctcatcacacttcagtctctctggactgttgcttctgcacccaccaagcccaagtcctcccctgggtttgtcatttagccaaatagagcccagagggaatttcctcttgtgacagacccaacagcctgggttactaggatgtctagctaaatcattaagttgagtcctctaatagaccgtaggagtgccaaatgcctgtatattttcagtttcttttttacctgcctttccaatactccagatcagtgactcccaggcatcaggagcgggcatcagaatcacctgtacagtttctgaaaacacagattgctggccccccaccagcatttctgattcagtagatctggggtaaggctggagaatttggcatttctcacaagttggaggtgacgctgacgctgttgatctaggggccacactttgagaaccactggcctaaaacatcaggtaaatcacagtgtcgacgtttccaatctcttgcaaatggactggtcctattcaacccttatgtcaggccctgagacaagaacccagaggcatgctcatccaattatttttaagtggcatgaagcagagagtcatagaaaatacattggatgaaagaatcaaagttcaaaaggttctccagagttggaaaaatcggcaaaagaccaaactaaaaagatttacaaggctttcatgtcaagtacagcatttaggctaaaaaaaatcaactatataaattcaaaatgagaagacctagcttggcagcaggcaggagagaaataaaagaaaacaaaacacacaaagctaaatttaagtgtgtgggtaactaaaacctcaaattttaggctagccatgtgacattacagagaaagccagtgtttactttttagaagtgctccccagatcaagggaaatgaacatttcattctgttgtgaattggtcagactagttccagagtacttgatccagttttcagtcagatttaaagagggaaaatgatcaactgaataacttccagagaaaagtgacaaagacaagaggaggtagcgtctggaaaagatcttttgaggaacagttaagacagccagtaatatttggcctgaagaaggctctcgtcctcacagagacaggatggttacatctgaatacttcaggtgctgctgtgtacaagattaggtttgtcctgctttgttctagaagccagaattaagactgactggtatatattccaagaaagcagatttttgtcttgttttataaatgaacttcctaaggatgtaatttgtctaccaaacggagaaggttaccttaaaaaatgaaaggtctttgtccctaagactcagtaagtatttctccaagttactatggaaagaacttttgctctgcactaggaggttgaatcagagagcccttctaagtctctgctagtgccaagattctatggctttgaagttattatttctctgcacatctcagcaaacacaaggagcaccaagggagcattcccttcactttcagaacaatatacaatagttgaactagaaggatggaagactccattgtgaaaacaaagagcaagtccaagggttccacactctgctttcaaaaatactattcttatgaaattccttcttgcaaaatccgcttctgtgacaatcttgtgcatcctaagccaaaagtgggtactccagggagagatgacagtgccctccctgatgagagcatggttaaatagtctcatggaggggccacagcaagtggtaattgctgtcaaactatcaaaggaccttccccacactgcagactcaattccaacaactagccctaccctttattccttcctctccctactctccagtggcttcagatggccactttcccttttacttcctgggcatcgtagagaacacattggtataactggagaaatactcacttgcagtaatatcatctgagaacctgagaggaatgaggagaaattcagtttaagtaatgaacaagtcaagcattgtgtgtgaaaggagatttttttggtccaagccctaaagagacagctctgaaccttcatggcaccttcaaacaaacaagcaaaacctttcagagaaagtctctcctatccgcatgtgctatctaaggtataaggctgaggcatttcatccttgggtcccccatggccctgtctggtttgagttctgtaggcatattttgagctttctttctcactgtccaccttgacacttggccatgtgattatatagaaaagttgagtttgttccttatctcagggttctgtgccctctttttttggatattatattttctccaacgcagggaaggagtgagggtgacctgctgaatgcttggagggaaatctctgtgcatgaaacaaagagaagagactgacccaggaacataaatcctttgtttctggaaacttcgtccttttccatttgaagtaaattgagtctgatgaaaaatgccagtgttagtgcccagaagtctggaggcaaatcctctctccctaacttggagaatataaagagcaggtctggcagacctggctgcccttcatttctgctacttcaccacccctccctcctctcatggagaaggaactggaaatacgctgtcctggaaaaccaggagagatggatttcagtcctagttccatctctcactacatacaattttgggaagccactatgaggaacaaagaaggccatgaaagaggaaacgatttaatacaattgcccaagtgtcagggtggacagtggaaaaaaaaagctcaaagaacttgcctctatctgcactgggctcatgggacttggcttccagagataaaggcctctttcactagagtctttgggaaaaataaaaaatccactgagaggtaaatcatcaggagtgatacttttccaagaagttataaaccaatctttccttgaagagctttgagccatttacactcaaatcagaagatgcagggccagcatttaaaagatggccagcatgaaagcgtttctctccaagaattctagtgatattaaaagatacactttggagagcatcagcccttctataatgcctactctcgggaaccacagtttggttcaatgggctgtggctccatttaaagagtcggtggcagtaagctcttctgtctccccgctcgctggctgcagagtggtggccatgatttgtgcccagcagagctgcgctgtctatacagagcttagatgccctgctctgaagttaccctgggatgctaaaatgcacagatggtccaacgagtactaaagaagataatggatgtcaaagctcttttaaaaccataaaatatgacacacatgtctacaattatgatgatgacaaactcagggccagttttacatggagagaaagtaggcagcttccctacatccctctaggccctagaatattactattactggatcataggggattgaaatgcttcatatttcaagcccgttgtccaattatgaaatcagctatctcttggaatatgttcatagtgacatgactttacaggcacataccaggtcctttcctgaaagcaaattgtaatgcatggagatctctaagcatctaggatgagtgcagcaaaaagtgccaagaaaggcagaaaaaaaatgttgaaagggaagaggaagaaaatgtattgaaagagtaggaaacatctcaggaaacacagcaaaactgtgaagcaaggtgaagaatgtccatttgcaattctacaaggaatgaaagacaaacaatgatgagtggacgttttcttctttctctagaagagagatatgaaagaacaacaacaacaaaatgccctgtgtcaaagtcactctattccctgtgtcctgactaatcatccaaggatctgtaagtgattctgcccaaccccaaaactcgaatagtttgggatggttctaaacaaaatgtgttttaagcaaataatcatgaattggttgatatcttcctcactgtttctgaataattacaacacagaggtttgccaaacacattcaggttgctatgatcatgtgattactgaccagggactgtctggatcccaggccggctgagctgctttgagttggacaataaccacagctaaaatcctccttaatttcttgaagatgctgcatcagcactcattggaaagagaaaaaaaaggaactgacaaccccttctaaacatacaacattaattttcctattcaatctaaattcagccaaaaatctaaacaacagcttaaagcactcccacactaaatgaaatttcagatcacaaatgaaagaaggagagctcgttgctgcaggagctgtcactagtcacagccttgctaataaaattcacctccacctacaagggctgccatcaaaaacttctccagcttgacacccgtacattaccaatatcctcactttatctcttcagtgtccttgggttttccagagacaaacaggcgaatgtgaccttgggtgcccaccaccaaatccgttggctggagaacaacacgttctgcaagggagccacctgccgagggctgggcagtggctggcagcagtcagccgttctggatggtgggccagtcactgacagcaggctccactcagtgacagcctctgatgggcctccacacagcaaaatgggccagcacttgccagcaattaagaaataacggcatggcactggtgcatttggcagaatggggtttttctctgcatcacctgactgcctatttcatagggaatatggcccataagagggggtacgctgttactcataacccagcagcgagttattctgtacagacaggacacctggctccaggtactgggcagcctccggtttctaggtttcattaaggacataactggtactgcatcaaatggagaaaggtgccaccttccctcccctaaagctgtttttttggaagtttattgactggctgagagaaggagcactgcctttgaatgagacactggactctggtttactgagaagtaatcacagggaaacagcatagactctgacttttgtcttctttctaatcaatcccccactgtaagctataacacaaggaaaattcctttctctttaatctctggatagcttactattttcctgattcaactctgcaaattctcatctcgactctgggaatgtgtcccacattacactcttacagagcgcattatgcactcactagttcacctggtctcagatagagaaatcctatcactcacttgcctggagcattctacaccttaactgctaaatccccgaggacacaaaatagggcttctccttcactgatattcctgtgggtgtcagggagagtgctaatcacacagtatgtattcaataaatatttactgaataagtaaatgactgcagcacatacaaataaaagttgttgtaacttaagtatggatgggatccaagagtaaatcaatagttctgaacctcgggttccaatagacacttcccgaatgaatgaatcagtacatgaaggagcatccttccagtgaccaaatgcaaacacgttgtttggactaaagaaatgggccagaggcgtggtggctcatgcctgtaatcccagcactttgggaggccgaggcgggcagatcacctgaggttgggagttcgagaccatcctgaccaacatgcagaaaccccatctctactaaaagtacaaaatcagcctggcatggtggcgcatgcctgtaatcccagctactcaagaggcagaggcaggagaattgcttgaacttgggaggtggaggttgtggggagtcaagatcatgccattgcactccagcctgggcaacaagagcaagactccatcccaaaaaaaaagaaagaaagaaagaaatgtcccaggaagatttttaacaatcacacctctttacccaggtctttgagttgcgcacatgtgggcatgtgagagtgtgtgtgtgtgtgtgtgtgtgtgtgtgtgtgtgagcctgtataatgaggaagaagaggctggacctgtggatgggtcttcagacctggagcgggctctcgcactcctaccttgttgtgatactgcagcatttgagtgatgattcttatcttcggatggtagttctttatggagattactctgaaaaagaaagaaccaatgctgagacaggtctgccttatgcatggtgtctgacaaaaagatcaattttactgtctccaaatggggtacccatgggactgaggtaggaggcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtcctttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacccggtgacccagaagttactaccccttccctagaaatttttgcataagctgccccttaatctgcatgcaattaaaagtaggtataaatacgacagcctgcccagagctgctactctatggtgtagccccgctgtgcaggagcagtcacagagctgtaatactactgcttcaataaagctgtttccttctgccctaccatcagcttgcctttgaattcttttctgggggaagctaaaaaccttcatgggctaagccccattttggggctcacctatcctgcatcaggaccagcagccagggctatcctgaggggttgcagacactgggccaggttaaacagtattcccaccaccatatctcttgctagtgtgaaaacaaaatcacaaaacagccacagtctgtgtcctgggcatgaaaaatttgagggccccttggaatgcattggagatgggatgtatgcatgtgcgtactggggagtagggggcctggagcaggggctgccagcttattgcctacgtagacatcgaaagcgagcccaaatcatggggcctccagaggtttgcaatctcccacaccctagggactagcccagaaacaatctgctgagtccaattctccaagttaacaacttgagacaacaatgacaaatcaaacaagcaggatgacaaatggttctaattgtgacacatgcttggccactatcacaaaaaatgatttctaagcagggcttttaggatgagatcaaggactcagccttccatagctaatagagaaaatgatgacttaaacgctggttaaaaataagtgccaaggcattgcgggggtcatgatctggtggaaaattgtctcctacctgccctcagtccaaactcaatgttaagcatggcctgcacccaccccaggcctcacgtgtcctccccacatcaattatggtgctaaagggaggggcagagcgcagatgaatggaaacacgtgggttccagtcacagctattgtactaatgaactgcgcgacctttaggaaaaccctgggctctctgttcctgtttcctcatctggacactgggagcaacagtacctgctttatttacttcacaggcttggtatgagcagcaaatgggagaccagatgtgaaaatgctttgaaatcattaaaagttctctccacgtgtaagttatggtttttgtcattaccaagtctgtcagaagtgacattgtacatttccttctgtgacaaggaaggctaaagaatggaattccacagaaaggcccacctcctaagcctaatcagaaatgcaagtgcatttattatgaccacccccacaaacttcccacccagcagcgctccccacttcaccccttttagtgcagaaatggagagaaggcagccagggagcagctttatctgaaaagctgcaacgtacgaatttaggaaatggatcacgctaaagcctctcccagcacaaattcaccctgcgtttttgcacttgaaggatttcattttatttttgaaaaagtgttgcgttggcccacgcttataactcaaggactttgagcctctgtcagccctgccttgcagttcacagcttcagccagttttctgcattagctcatttcaaatggatctttgacattttaatttcaaaggaggcagattggtctcattaaactgaggaggaaggaggattatacaaataagagaaagacaaagcccatttttaaccctgaacttcccacttctttttgcagccaaggcctcagttctggctctacttaattacatttctgatactacctttgaccagtaatttctttttttcttttctttttttttttttttttttttttttttttttttttaagacggagcctcgctggctctgttgcccaggctgtagtgcagtggcgcgatcttggctcactgcaacctccgcctcctgggttcaagcgattcccctgcctcaacctcctgagtaactgggattacaggcacacaccaccacacccagctaagttttgtatttttagtagatacggggtttcaccatgttggtcaggctggtcttgaactcctgacctcgtgatctgcccaccttggcctcccaaagttctgggattacaggtgtaagccactgagccccgcccttgaccagtaatttctatgcctccttgtcctgccagtcaccctagtacctatgtgtcttcatattaaccctaccacagttagggtttaaataaaatactacaattaagagaaacacccatttcaaaactattactcaggtagccccaaacatctctgtggagtcaaaacattaagcttcatcttcttttggttttccatttggaattttgaagacagtgaagccaggttccttaaagggttacatttttttttttaaatcatttccaatgacagaaaaaggtgtcaaaagttgaaaatccttcctacttcaaagaaaggaacaagtgacacacccaaccctgatcctggtgtagccactgtgcagctgtaactgattcgggaatgagcccaggtgtgaagccagaatctgttccaccctctctctgcagcctggcaagcccaaagcttagaagagttcacgcatccacttccttaaaatgacctcactaagcatattgccaaagaaaactgagtggcaagagaagatggtgccagatgttgcctgccagacacaaggaccagatgcttaagggaggactggctcctctgaaatgcactggaggaattcccccacctcactgatggggaagctccggtcacttggggccactgatggaaagcaaagacaaaggcaatgcaaacattgtcaggatgtaaaggtaacttcttgaccttcaacctcaggtaagttcccaggaggcagtaaaccaagccaccggtagagggggaaccttcggcccgaaagatggctgttcacagttaggtaaaagttcctgggaatgcagtgggacggaaatcccactgaatttagctcaactctccagaagcttccctttatcatttcctctcagccctcttaactcttctgcaatttatgctacagaaaagacaaattccaaagggcctctaactacctggagcaaaataccttgactttttagtcatttcattgtcacacaatgtgactactgggtttatgcaaggaacaaaaactgaacaattgctttttttctgaattaagaaaagaataaggtgctggtgttggggccaatattagcagttgacaggcctaacccttgtgcacaaaaagcactgcacagtgtttcccagtatgacctcccctagatgttctgtaaaaaaaaaaaaaaaaaaaaaagggagggcagggcagggcagggcagggccacagcggcacactcctgtaatccagagttttgggatgcccaggtgggaggatcacttgaggttaggagttcgttgagatcagcctgggcaacatagcaagaccctgtccctactaaaaaaaaaaatctaaaaattggccatgtgtggtggcacattcctatagcctcggctacttgggaggctgaggtgagaggatcgtttgggctcaggagttcaaggttatagtgagctatgattgagtccctgcactccagcctgggcgatagtgcgagactctgtctctatgaaaaaaaacgggggggggttgggggaggtgggagaggagcagaggcttatagtcaaataggtttggaaagtgttctatagtacgttatctcagagatgcatattagtattaaaagcactgaaaagcctttcaagaaagaacattaattttgggaaactggatgaaacagcctaactggtcactaaattcccctttggggtgataggaatcaatatgccgtagacacacttggaaagccctagtaagggttttctcagcctcgacaccattaacattctgggccagacaattctctgttttgggggctgacctgtgcattgcagggtcgttcgcagtgtccctgggctctacctatcagatgccagcagcacggtcccctagttgtgacaaccaaaaacatctccagacattgcaaaatgtcccctgggggcatctgcctttagttaagatatctcaggcccatttcctttagggaacatggtactttaattcaggccagcacccatctcaatctatttcctagttctgtctcaaggaatctcaaacccaaggccagctgtaagccctagagctgccacctgctgagggtgagcttccggttggtgacaccctgtgtgccactgccccaacccacacagacagcctcggctcccccaggcctatgcagctggtgagttgtacagtggcttgtggggcaaaaaggcctcatagagatagtcctctgcagaagatccaaaagggccgtgaacagccacagactgccaagcccagggccttccgcagcgccccaagagttacctcatgatattcgaggcatcctccgcatccgggtcagcgcagtacttgttggcaaggatcaggcatgcatctgctgactctatctaagacaccgaaaggaaaattcacagaacacaaacatataaatagccatgctcgagtgtagtctctctctgttgacagcttcttggggaagctttgcaaagaaaaaaaaaaaacaatcctgagagcctgagagattatagtttttgtcaaaagtgtaggttccaagttcttgttatggtataaacatttcatcttgttgctgttggagggtacaacatgtaccttggtaattatacttttcatttggcatcgttgcttacttgtaggatttccagatttctttaaataacaattaattaagcctttcagtctcctccccacctcctttctcaaccatctgcaccatcatcctaattcttcctatcaggagttggaggtgggtgggttaaatcccttctctccagttagcaaggtaactgagtattggggattcagaaatgtacactctgaagtccttcatctgacctttttcacatcttcattttctataggctgggaagagatcagagctctaaatcagataacatcaccatattgcttagtatccgattagtattcagatattcagaagacaacaaatctatgtatgaaataatgtgttacagttgaactcaaaatatacctactgacttatccaaacacgagcccacaggggtttattccttagaggggaccatgagtttgatgtgctaatgattgcttgcatttaaattaggtccacgaacaataacaattgtccctacgttctcataagattttacataagcaataacttgagttatgtctggataatatcaagattaactggactctatgagcataagaattcttatgctggctcaggtctgcaatctgtcctacttggtatgttatacttaatagatcattcctggattttgagggaggccataatatcctccgtggtatgtcacaaatcatctctgatttctttaataatataaagaaagaatttatccaaatccttttggattattcatcttggccaattatattatttacaaaattatgcggtgaccacagttagcatttagacttcagtgaattcattatattaatgtacaccccctggcatgcaaatattgaacatgcttacaaaatctatattacataggtaaagtagcagatgccattttgccttgtacctttcccttctaagcctcaggtgtgctttatgagaagattctaaattaccagtttctggaaaaaaagattcgcccattatcaatgatatcagataactgcatgtttagttttacaccctgcgtcttagatggggaaaaaagaaagctcaaatgttttatcgcttagtaaaattttattttatattttagcctaatgtttctttcagatgtaaataatagaagtcagagctatattgagtccaacttaagtgttcaatataggaattacttgattattatgttgtataaagctactgggtccatataactggtctacttccttgatgagtagctgattttgaggaatccagcaaagcaagtttcatgttatgaccagtccaagtgtgggatggttataggtagtgttgcatatgccagcagaaggaggtcctgggaccagtggaagggtgacctcaaggttgctggtatgtgattgatctcattaggtgtttaggagatgactcgtggccaacctaggaggtgtgtcccctcagcacagagtcaggactccccccagacccacaccaagatggaataaaagcagaagtcacctcttcctccttaccttgactcttgcaagatcatgtggattgaggacggaaccctgataaaattccacctgagtaaaatgtcgtttgaacagagcttcaagctccaggttgggggagatgctacacagggagagaagaaatcgctattaatttaatggactcgggggtttcagcctccatgggctccttcctctctaatttccacagggagccctggggagaggctgtgacctacagtcacccttttgcttgccataaataaaagactcacactcaagagaagtaaaaccccagcccaactgaaaaccaaaccagtaccatggtaaaagaaagaggttcatgggctttaggaaggccaagacctcaggacaaatgtcttctcttcggtatgaatggaattcctatcttataaatatggaagctgggctgcgccactagtgggatggttcattttatgcggactgtgccagagggtgcccagatccagtgtgatttctgggtgtgtctgggagagtctctggatgagaatggcatttgaatcagtgaattcagtagactaccctcctttgtgggagtgggcatcatccagtcctttgagggtctgaagagaacaataaaacagaggacagaggcgtttgtcccttttgcttctttcctgccggcttgaactgggcatctcttgtcattctcctatccttggactggggttgacattggctctatgactctctggccctcagactcaaacaccaccagctttcctgggtctccagcttgctggtggcaggcagtgggacttcccagcctctgtaatcaaatgagccaattcttcctaataaatctctctagagatagatagatagatagatgtatcaatatatagataccgatatatatctgtattagatatattgatatatatatttcctattgactctgtttcactggagagccctgactaatacaatcaaggattagccgaaggttcccctgggagaggcatcctgctgttccctccatcatgaaccttatctctgcttctgtgtctcatggacttctcatcccccaaggcctggatcaaaaagtatcactctgaggagccacagacagacttaatttactctcattattgttcttgattcacacacatgtatgcgactcatcacatttcttggtgctgatctgtactgacatctttctctttggaggacaaggattaaacaagtgacctatttattcatttgttaattctgcagagatgaaaaagactgtcgataaggtaccgtgctaggcactgggagatgatatttagttagaacctactatacgccaggtaccgtgataagtcaacacttgcctaacatttgtgaagtccataatgacaataataataatagttcatgttttgtaacatttactatatggcagataacattttaaataaataatagtaaaatagtattataaataaataagtaaaataaataatatttatttattttattttattttacttagagtttatctctgtcacacagactgcagtgcagtggcaggatctctgctcactgcaacttcccaggttcaagtgatttttgtgcctcagccttcagagtagctgggattataggcatgtgccaccatgcccggctaatttttgtgttttcagtagacacagggttttgccacattggccaggctggtcttgaactcctggcctcaagtgagccacccaccttgccctcccaaagtgctgggattacaggcatgagccaccatgcctggccatgatgagcattaattcatttaaatctcaaaacaaccctataggcaggtatgttattaacccagagcttcaagaggttaattaactgggccatctactataagtatgacattgatggatgttagggatacaaaggtgaatcctagcaatggaagcatgagcagccagtttttgttttgttttgttttgttttgttttgttttttggagacagggactggagtgcagtggtgccatcttgactcactgcaacctctgcctctcaggatcaagtcatcctcccaccacagcctccagagtagcgagggctacaggcacgtgcccctatgcctggctaatctttctatttttgtatagatggggtctcactgtgttgcccaagctggtcttgaactcctgagctcaagtgatcttcccaccttggcctcccaaagtgctgggattacaagcatgagcaaccacaccttaccagcttgtttattcaaactaaagcagtggatgagagaaaagtggctgcctctgtgaatctgaccagtctttcagacccatgacaagtcatacctcattcagaagcctgcccgggtaataccatagactgatgctccttgaaagagatgtccccagtcacttctgccacctgatcaaaatgacttcagcatcccttggataacacagggttgatgttgtctctaatggttgcatgtgtgttcatcttgaaatgcccaactcatgtgggggcacagcctacacactatacctctagagaactttccaaaacgctcagtagaggatgggccacacagcaggtaatcagtggctaagcactgaatggaacctgtgggtacctgctcctgtgctaacatagcctggtctgttttttcaaagtttggagaaatcagtgcagaaaagagaaatgttggtgccccaacatggtgacaagtcagaagtctagcattctgtgagcaaatgccagaggacgacgatccaccaaacagggagtttgtagggaagccgacctcagtggaacctcagagtaggaccgcgtgctgggtagtcaacagcacgtcaagccagcacaaacatgttagctttgtcctggactttgcgatgtggtgccaggactggccccatgacagccccatctccataaaagaagatgaccatggtaccacacatgtcaccataatggagccccctaattctctccattcctggggcagactaccttttatctaaaaagaggattagtcaaagttgaaaacctcaacattgggtagaagggagataccttgctttcctcccctgtaaaacatacaagataagacctacctcctaagtggattatacaaccaaatatatgttatttttcaggctgatagctaacacttattgaagacttactgcacgcctgactctgctctgcacacttcatatggattaattcatttcattctcatcacagcccaactaggtaggaactactatcatctccatgatttatggatgaggaagctgaggcacagggagcttaagtaacttgctcagccagtagttggttgagtcaggattcagatcagggaatctgagtccagaatatgtatttttactctgtttgtggagtaaatgggagcctgcatgcacagtgacgggctagggtcccatgctgggggttcctaggaacggcagttgttattactattaccttctgtcctgcttcctcttaagttggtgtcttgcttggtcaccaactgactccagaactcctaacgtatccacaccatacagctaatcatcccacagcagataatgtggacacgccagattgctaaggggacaatgatgatgacttggacccacaatgagctccactattatttcttccagagataaactcggatgtggtcccagaatcgcctccacagaggcagactctgctctcatcattgaaccagtgtgttgcttccctttccattggttctgcaatatcttctccaacgaggccaaaagggatcatggcttacccaactctggccccatccccagtgccattccccaagacctccactcttacagacattcagggagtccctcgcagggtgtgtggttgggcagagggtctgacagcagtaggaagctcttacttgtgaagaaaaacgatctccacattgacgtcatcccggtccttgtgcagaaagtccttcaggaagttggaaacactctccagagtgatgtgtccgcagaccacaatgtgcctgaacaggagaggccagttagatcaggccaggcaccacgacaggaccctgcatcccaccccctggcaagacagcagaagccaggcagctgcaggggaagcattcatctcctccctccgcctccataaaagcccagctcccatccccagagggcagtgaggcaaagcagcggtgctagcaggtgctgagactcctagacagaaaagccatatggcttctcacctgatgctgcacaaaatcctattaaaagcccaactgtttggccaagtggttttatgcatttaacaataagtgacattatgcttgtgcttaaatgctgcattatcaagtcccttgcagattcatatctctccctttctgcccacaaagcgtcctccggggagatttactgtatgagtcttggtttatgacatagagcttatcaggtaatgagataacaaatcttgctgaaacgatgattttgtgtgtaagaaagcagacttttatcagggtggctaatgtgcggcctgacacgttataggttctgctggccataagcagtaaaaaggaaattttgcatttttccactataactcctccgacaatgggggcatgtaacactttacagtaagtgagcattactcagggctaaatggggctgggatgcctatggaatggaagatcatgccagctggctgtgcgtccccagagggctgcttccttagggtgcccgggatttccaggagagctaaaggaatttacctcaagatggggagatgctgggaagggatgaggctggaattgctcgccttgtttgagggtggtttggacttctgtttctggaagtagtggctcacccggaagagatgagccccacaactgttgagactgacagtccctccaaccgctcggggctcctggccaatctgactttggcaccaggcaatgtcatggccacttatatgtgccacataatgcccagtcaggagtgagcatttgatgcaagagtcagccacaagacaaaaagccagggactgactgtggagataaaaccactggcttctagtgaagagactgtatgtagcaagaggctcgactcctgtccctgtgccccccaggctcatagtgacagcatctgagtctctagctgcgctctgagacttgggcaggtggtgaacatgcagcatggtaatttcctgggtaaaatttagaatggccatgtcccttgcacttcataattgctctgtgcacattccactaaggcagaaagctcattggctggaggtggctcataataggaggcagtgatgatggcttatgcaatgttccattagatgccattataagagcctgccctttcgttgtaatttggtgcttgactaagtatgtgagaataatgcagtaaactcattggtgaaaggataatgatgcagaacaaagagtaaatcaataatatgcacgatgcagttaataatatcaccattatagactgttattgttacggtggtgcacttagcaatcaggcacgcagcggccaccaaggtgagggaagagtgtcaatgagctacttcagaagagatgtcttaacatgatcactttgctctcctgctaggttgatgaaggtcccttagccacccacccaaattttatgcccaaagcccatatgactaaccccctcattagtatatggtgagtagtatgaggctaagacagtgtgacacacagtgtatcagaatacacaatatagattgaacatttggatgatatgcattttatcatatattttaaaatgtttcttgtggcacatgtacatttacatggacaaaatacttcaaataaatttgcacgttctgaataagatttcagactttgaatttgccaaatatgtttgaagtgaatgagaaacagaattcccctactgacctaacttccttgcaactgacaatagggctactttgccattctaacatcctctgcacatagacttccaagattaggagcaaagccaacatgaatccaatgcgtgggtatctccacaggacagatacgtggctgaggctgttctcatcacttagatgtgaaagtaagccagatgtgattccctgctctgcgaccaagggtgtgggcaaagtatttattcccattcagtgcaggaggaagctgagaggttaataccacccagccggcctcctgtgccaggcattgtaaagttcgaagttctataccagcataagcctggttattactcaaagctaggctcaaatcaatgataggtctggggaaatgcctgaacattcgttcttcctacccagcatgcaaagaactgaatgaacatcagccagcatctcctcctcctctctgaaatcattcatccctaggaaagatgtgtgagaagtgcaaggggaaaagatgagttcccccctctcacccttgaatcaaaagctcagctggctgatttattcagccttagaaaaagtcagggttctcttccttgaaaatgtactgggtacatataaaatatattccaatgcaatcaatattatcccttaagcctttaattaactttcacttctcttaagaagtagacaaatgctggcaagagtgaggagaaaaaaaggattgacttttttcatttggtgctagctatccaataccattctagacaattgaaaatatatatcttttagccacagcatgatttctggggtggagagctgtctttatcaaaaaaggaagaaaaaaaaccttccttcaacgtaattggtatttttgctcagaaaaaaagcgagattgattgaaagcagattgcctttttgcccaaggagagttattaggtacattatcatggcaaccttggagaacccatattgttccaatctgtcctatatctgatttgaagatttatggcctcccccttttgtgccaataatcatttccctccattttgttttccatacagtgaaagttatcaaggagcccacatattgaaaatgtttgaatgcagttagaattgatggatggggagaagctgcctctaactcagcaatcggtattaggagatctgcttccgccagcctgtgtctgaggagggccctgcaagagcatgagggatggatggtgaatggggaacatttatttaccagaaatattttcaagacttttgaagattctagggccatagtttggggaaggatattattgcaggaagaagagaactagaatttattgcatcctcaattattagagatatcaacacaaatatgttaagatagacagcagggtgtgacctcattggaggcagagtaatggttgttcacagggcatgatttgaagaatgccaaaaaagatccccatccaaagttatctctgttgggttccatgatgcctacatatctaccatgtgagattcatactctgatagccctgtgttaactcagctcagacactaaataactaaatagtcttggacaatgtaccaattttgcattttacaattaaaaagccagagcctttgaggggccagagctggtgcctgattcatgaagttatcctgatatctaaggagatgatacatggaagggccaagtaatctgctccatggtaagcactatgaaatggtaagtgccatatggtatctgtaaattaggatgtaaccaatataaagtattctgtggcctatgcaatcccacctaatccttcaacaaccctgtgttctcactgcctgagtcttttcaggtaacctctctgaaactctttccttaagtcatatatgcctggcatcccacagcaagtaaaagtgacttgcccaggatgcaatctgggtctcccacttcagttcccactaagatgaaggtggtggtggaaaggaaagaggcttgtatatctcagcttctgctccttcagggcaagcagaaatggacccacagaggtcctcctggatacatggtggagggggtgttggaggggtcctccactggccaagggagaggtttagtctgggaactggagtggataaaccatcacagttttgcaagatcactagagtctggctggataggcagtatcatgatagtcttagcaaagtctgattacaggcagaaatcataagttccaccggtcaggaactctaagccaaacttaactgaagccatatgattggagcaagctaaggggctgcaaagtgatgcaaatgtccattttattttatattatattttatttattttttagagacagggtattgctctgttgcccaggctggagtacagtggctcaatcagaggtaattgcagccttgaactcccaggctgaagcgatcctcctgtcttaacttcctgggtagctgggactataggcatgccaccacagctggctaattttcttttggtttttgtagagataggttcttgctatgttgcccaggctggtcatgaactcccaacctcaagtgatctgctcaccttggcccccaaagtgctgagattacaggcatgagccaccgcgccctaccccaaatgtctattttagacatgtcatgtacagctcaggacttcctcaccagcctggaatctagaagataataagaatcttaatgatccatttacaatggggaatatttaggaaagttcagctatgagagtagctaaatctctccccatctgtggatgtggatctgaactttcttagaccatcagcgattgtcctgaccaatttctatagggcctgaccactcaatttgtgaagatgaccaatagtcctcaatcaataaccatttctgatctgatgaagtttttggttttaaatgctaggtctggatctgtaaacaaatatttcttgggcaaaggtaacataaaatagatataagctgacaggtcatggcttagaataaaagatccacctcagaaacacaaggaagcatcttcaatgccaaaatagtatccaacggcactttctggagaggaattattcatccagtgtgagcaagtagtgcctggtgctgggtcagggctccataaatatgggctggtttaactgaaaagggcagtgcggtgggtcacggcattggaggggtaagaatgacttcatgagaagaagtttgatgattatgaacactattgagggtcaccataaattcgccagttgcttatttcatgtgcatatcttcactaaatatacatgggtgtgcttctcctgccatttaagcatcgctgcctccagaatgaaatcccacaaattcttctcaatccttctactctcttctcagtgatgggccaggaaagcctgcatgcccaagttgagccagaacttcagtttcagagctcaattccacaggtacacaggacaacctaggggaagtgacttaaggcagaaggcagaagaggacaggagggcagtgactgaggcatcaagagagccactgaagatgacttttaggtctatgacaaggaaaatctacatacttttcccaagcctcagatactggttgttagagccagtagcctttgaaaagggaaactgtgaccatggaatagtcaccattgggccccctcccacgttcttaagtttatctcagcatctgaatgaatagcccttggcaattgtttaatctagcacctttcttctctttgatgtggaaacaggttgcaagatgagtgccagatccagagcacaacacctccctcagtttcatgccttctgatgaaagaaagcagctggtgccagggaggataacctaagctgggaattgggagactggggggcgagttctcagtgacctggggccagtcactaaaatgaagaggcccaggctgactgggctgcacccaccagacactgatgaatcctcacacagggctccagttctctgtccgaccttagttcacacctccatcataccttatctagacatctgcaatcgcttcctaactgatttccctatttactgtccccactgcccccaaccattcccacactccctcaaaaaagccaaagagaagggatggcagcaaatcctactgcgatcaggttctgcgagggcggggaggccttagatctttctttagcagagcctcgctctaggaagacaatgtaaaatgcacagctctgggctgtttatttttaaagatactatatccatttttactggaacgagtataaagaacttaaaaaacccagagctatcttgtcacaataaatcagacagagtaaattgaaaatcctatacagctttgcctgaatacattgtgctcactttgtcaaagaggtagatgaaatgtggcacatattgatctagatgtctctgtaaaactataatatttatatcaaatacatatgctagactctctgtctttctgctgagccttctaattgtgttttcctcgtcctgctcctcccaaaatgcatctcaccattggtagcccctgacatgatgggaatgaattttaagaagtacttctcaagagaaccagcagcactgtatcatacaggaagcagggcgtggggggttagagacccaacgacctaaaccacacagtggtcagcaccaaagcttcacgtttgcccccctaggttgaccttgaacccttggtgtctgcatcaccacctctccatgacactcctgcaagctggcctttcctttccttctcacctggtagtgcttttcttggctacttagtcttaatgcaggtttccctgatttggggcatgtccttcagggttactgtttcccagcgcttcccttgaggctcaatcccccactgccaaaaaataagactaatccaactcccaccttcccacttcctcctttactgaatgtctcaaagagactgacttcagtaaagataggggagacatcatgggcaaatgaagcctaactccaggctgtgctgcctcatccctccaccctaccccaggacctggcttggaacccccaaaacttgctgggctttcaggaactatttgttaactgatggattggttgacaaagtatgcatcttggagactctatcccatggtaagtgcagaaaaaagttaacaggtagttcactgcaagccttttagaccataggcttattccaccaccctgaatctactagcatatttcaagtttgtaagggatctgtacacataaagaaaaataaaaacaaagcaaatgagagtgtgtatcagtcccacaaccccaaaccctgactatcaccatttcctgttaaaataatttttttaaaaaaaaggaggttcagcaataagataatttcctatccatggacacatctagtactttgctaatcacaaaggaaggaaatgcattctccctcctagtgaggaagtgaataaagtaatcttcttctccagctgtcaatggagctgttctggatgtggcaggctgtgctgctgtttccctaaatggggcagaagtctgagcaaatagatcccaacagtgcagcaaaggcacctctaaagcagagccccaaggtcagaggacagacaactggcagccccagtggggaataccgggatgtcccacctgggccaaaactttgcatcttatcgcatgcagacagtcagaacctcagctaccctagagggatctgtgtctacacctccaccatcccaaatcacagttagacctccataattagaccgtggtgagaaatgatcacacatattttgtagcttgtagcctacatggagcctcagtccaagtctttaaattctgagaaactcagtgccggggacattggtagattttgcctgtcctgcatacaccctctcttctgtggacagcacctcattttaatttggggaattgctcctccccaaattaaatacagtctcccaattatatacagtcttgggacctttagtgaaggttttctgcccaagtgaggccaatgggtactcttaaatcttggatgggctgatgctaatcacagtgggagttgattcaacctgatgacaaaaccctgtaatgactactcccgagtttccacttcctcagtgtcagagctgcatctctggttcttttctgtcctttctgggatcttgctcttcagtttttcattggaatctctaaggtaccctaacctttaaaaaaaaaaaacaaaaaacttttcttcttaagtcagcaaaaaaataagtttctgttgcctgcaaccagagaatcctaactggtagacttgtttacctttactttggtttctcacctaattctcactgttacctagtatgcaagtattaccaccatttaggtttctttctctctcctttcctttctttccttccttcctctctggaaggggaattctgcagctttcttcagtaagcaattccacagttgctgaaccctcacaaactgcactgattcctcctatgcctccctccccaacaccctcacccctctgcatcttattcatcccattactttgggcttggtggcctttggccattttaaaataagcaagtcttcccttgacctgaatctcccaatgctagatggttctctgctcttacagagaaatcagggagctgaatggcactttccttttttcagatcaaagcagatttgcccgatttcatttttaatgctgcttctgtacaagcagagactgagagaagactaaggcaggcaaaggtcagcctcactcttcagggatgaaggtggaatagagggagaatgagtccaagcaaagaaatggctctgaattttgcccaggagagggttttgatttacaaagcgagccccacctccctccctaacacccctggtgaatcatgtatcatggtccttgagcacatactgttgggactgaccctcccataatgacaaccaacttgacatatctttgccttgttctccagccacacccaacggtgttgccacagctagcataagctgctagccattcactctgtagactcaacatacttgcataggccccagcagacctccagcatctgttagtcacacagggactggaaggagctacaggttagaaggctggcggatcacctgcggtcaggagttcgagaccagcctgaccaacatagagaaaccccgtctctactaaaaatacaaaattagctgggcatggtggcgtacgcctgtaatcccagctactcgaggggctgaggcaggagaattgcttgaatctgggaggtggaggttgtggtgagccaagattgcgccattgcactccagcctgggcaacaagagcaaaactccatctcaaaaaaaaaaaaaaagaaaaggaaaaaagtaaaaagaaggcatgatacgaggcatgacaggccacagcaggacctttgtggggtctggaaaggagtggacctcaggatcacatcagcggattcccaaccctcccaaatctttctgcacccctcttttactgggtctgtaagcttttaggtgaacaaggcaatctgctattacctatgctctccactgttcaatgggtatgttcaacaacgtgaattatcaaatgcttttgggaggcttccctctaatgtctcttgctttcatgattattgtacacttccatgatttcaatgaataaaattcctgaaaaaagagcatttcactgggaagacgctcctgcatactcaagcttctgtttcactgccactgtttccttgggtggtactgattggtcagaatctcagataagctccaggagagcaagaaccacattttacccacagcacatggtggggattcaaattattgtttgttgagccaatatgttagaatgggagttttcctaaggctgttctatacactagctgacatttgcctttggagtcaatggctaaggtcatataagctcccactgagatgggcacatatctatctctgaactgcccccatgtcctcttgttagaaaggtacaaggaggggagatagattacttttccagcaactggtacccatatttggaacagtccctgtggttctgggggtgacagcaggccattgtgatgcaacaccagtactggctgtggagactggaacccttgggacaagagaatcagatttccacaactctcacaatgtattgacctctataatgttttaataaaaagagacactggacttggccagttagaaagtttcctggtttagtttcatagtatgatgacagcagcatggaaggaaccccaaagctaccaggaaccattttgcacagctctggaaagaagtccagcagagtgaatgacatggtacgaagacagaaaacagggggcaacctagtctggatggctgcaattgttcctgagattctgaatctacccggcaaggattcacccaatcaaaggagccattgatcagaatcttcagcaattataatttgagaaatcatattcgaattattttttaatggaagaaagaatatttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccaccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctatttgtcttcttatttactgtatctgtctgtctacagttcttcatatctttataaagatcggttattggggcctgtgtttccttctgactagaatcgctaccagatgatccttcctggtgatatgttgatgatttgctaatttatggcttttaaaatctaggaatccaaagacattgctgaggggttcaggctggggaagtcacgtggctcatgcaatgagggctgaatggctacttgatgagggatctaagtctgtgtaggatgcaaagcttcagtcacatttcgaccagagccatgtctgcaatagagaaatcgtaaatgacattttataggaaacacccctcatgagagcagtccgccccttgcaggcgaggaaaagtgagaatagctgttgcccaagacacaagtaaacatggaaagaaaaggcctgtggatcggcccaagtcagtataacatgaaatcatctcaaatccgattcccaagtgctagaggccatgccttcccagaaagagtcgagagggaaatggtgttgtagcaagactctctcagaaccaagagaagaggtttcaataagccctgatattggacttcccaaccacttaggtggccaaatagtacgatgtgtagctcagaaaagctgtggtatagttggagatttttatggatgtgtagaaatgcatctgtccccagtgcctggtagcaagccctcagtaaacacatgtggaatggatggacatgaaggcatgactcgtgttaattcctttaaggtagggtaggctatggggccatagattaaatgagtctttgtaaataaatgatccatgctctggcacactagacaatttaaaattccaaatcctttagaaatcagtctagaaccctggtggacaagacatgagtgtggtggaggaaatggagtggaattccacgttgatacaagacagccaggcaggagggaatagtgtgcgctctcaggaaggaacaaaggttctgagtgagaaggagagtccaaattctgatataaggaaagacacagagtttaaaaataacccaataatcaggaagcagggaagatacgcaggatgccatctcccgataagtcaagcaagcactgctcaggcaggttggggtctgagcgagcaatcagtttttaagacttcctctagtggaggtagaactgaagacctatgtttgcaagtggggcttgcataacctggattttaaaagcaagagtgttagctcccccagcttagtgggtaatgcaagctgggtcaaggtcattgaacaagcgttagttagcatctcctcctctgaggtgtcgcttccttggactactttatccagtgtaactaatccctgtttttctcagttgcagaatcttagtcttttctggttttgcagcacacattaaaaatgtgtaattggcatttgctttagttgtacccttgctcagtgcttgcaacctccttgagactgtaaactccaggaggacaggttccgagggtagtttgttcgccaatgaaccctgagcacccaacaaaacccagcatcatgcctgatgcataacacagagaatgcctgcctgccgagtgagtgaatgaaccgatggagaggggccacaggaatggacagtgaggcaggtcactaactgtgctgggctgtttttagttcttgaattttgttctcaactattgaatactcaattatttcttctaaagtatggaatcctctttaaaatatgagcatttacaataaagaagataattaagtactctagtttcatatttaaatagaaaagcatgacaaactgtccccatctctctgaatgtaaggctctttccaatgtggagaccacatccgaggttgaaggcagacagccctaactccctccagcgggatacaggctcctgagggtgaatattccaagtcaaagctatgaaacaaacacacagaatgcaccctgcagaactggtcacgtggggctctactgtgcctttcactgataaggaagaaaccacctccagatactgctctgtgctgtgcggcagactaactaaggagtgaaagggaacaggtggttccatctgcaagggtatagaaggctctgcaggtgagatctgcccagcagggaagtccaagtttagcagatcactacaattctccatggaactacctttaaaggatggagccaggaaggggaagaaaatgttgaaatccacaaaaaaggcacaattctcactttaggtgtggttcatctgtctgtccttgagagcctttcattgctagaagtgttcaagagggaattagaattctagtctaaccaaatgggaaaaataaaggaaggaatggttttgtcccctctccatctttttcccctcaatcctggggccaggacccttaggggtagtgggtgggcaggaggggagaggagacagccccaaagtgaagctcatgcctttctcttcctctccatcatgagcacggtactctggctccccttatacggaaaggtggaggaagatacaaacaataggagatcactgagtttagagcagaatggagtctcaagagatgacatggagaggcagcaggacgcagggaagcaggctgtccaggttcaaaccccagcccaactctttactagctgcgtgatgtcaggcaagttacttaacctccctgttcctcagtttcttcactcattccaaatggagatgatggtaatacctttctcacaggatcaatgtgaggattctgaaatatgcaaatatttgtaggtattactattgccagagaaggcagtcctggggctttaggctgcactgattcacattctcatttcaggaagtgtgtggcactcctgtctctataggcaaatgttccaagagaagccacagcatttaagtttcacaggcagctttcttgaattggagcaagagacgggttagtccatgacaactattccccaaaccagaatggcggctcagcagcttcatcctgaggaccttccttcaagttaattacactcactttcctctcccaccttggctacatctagtctttcatgactcattcccctctcgtgtgccctgtcagcatttggctaccaggaatcagtagaataatccaaacccatcccattctctctgtcccaaacacctgggcctaggattgcctcaaacttgagtcactcaagtcccaacatgggaaacacaaggtctgggtggctcccggctggactccctctaacaagggggttacagcagatggattcctctctgtgactgattattttccatggcccttggccatgtgaccttggaccacgatcttgtcagttctcataaactaaccaggagtggaatgaatcacactcagggaggagacctctgggggaaactgcaaggggctgtgagagggaggagagagctggggatcccaaaggccatgggagcgtcaccagccctcaggccttccctgtctctaagcagctttgaccttacacaaaggaaaggaggaggaggcagtggccttgggaggcaggctgggctgcaggagggctcccttatgaataagatttagggtatcagcccaagagcccagagagctctaatccctccaactcagagagattacctgcctcagctactcactgaacccttggttgtggacacccaaacccctattcttagatgctccaatccatcataacatacatgaaatagccaacacacacgcacatgtgcacaattacccatacctactgcagggactgggtatccttcaggaggtgatgaaaatgttgggtaaggcactctaggcccttgaaatagtgttgatggtgaagaggctttgagaatgctacttgaaatgtttatattatgccaaacacattgattaaaactgaaaatgaaatgccaatgaaatcttcatattctcaaatatcctgaatttgggtgttgtacaaacaaaaccctgatcttctctgcctaaattttgtactttaaataatctttgaatttcaaagttttatgtctctgtagctttagatcatgagttaccttgagttctctgacaagttaatatattgttagagaaatcatttctgaataaaatatgcacaagtaaacaaatcccttaactatgtatacattctaatttctttctgggcatttatttgattgggtcctggggagcagagaacatgtatgtgtgtgtccatgggcagagcacatggacttatgcatacacaaaaactcagagcacagcacactgttttaagagtctgaactttatctttcaacaaagtttagctgctttccttttgcaaatgcatttaattttatctggaaactttttgacgttagaaatagaacaactgtagtttctcattatgtttgctgccagaatccatgcttggttgctcaactaaagaccttatattgctaattactaccacatgcccatatcccaagcgaaagaaaacttattgattctgacagcccattctctcaacactgaattccaaatgaaaactcaaaatttggccaaacataacatttcatcaatcttgttttactgactggaaaaacaacatcaaacaaagggtgctaatggccctttattaccgtgcctttcccaagcttatattttctgatgaaagatctaagtgaccaaaggccttctttaaactacttagtaattagcttttgaaccaggaaacaatgcataaagtagtgaacaggcccggtgctgatgacaggacggactctgtgtctgcagggtcaggaacagtggggacccaaaaagaacattaaaagcaaagtgcattttcataaacggagaagaaaaaaaagagaaagagagagagagagagaaaaccaggctaaaagcggtgataaaagattacagagccagaacagagtggcaggaagtctgtgatctgaagtcatcagcacctgaaagtttgagtggaactgccagggtgaaagatgaccggatcggactgggggcagtgagtgagtgccgggctgagagccccatctgggtcagctggcaccgaaagctgccggcctccagcccacccaccagctcacccacatttgactaggaaaattatttcattaaaaaaaaaaaatcacctggaatgaaagtcaagaaatattttcaacttagccttcagggcaattgattttattgacttcttggggcagtgattgggaaatgctggcggagacgtcagaagatagggaggccataaagagagccccaggccctcagaatgccttctgctttatggagacctgtccacaccttcaaggcaaaatgaattgagatgctgttttcctcttggcatgggatacatgaccactgggaatctttggacttacttggccttttggatccaaccaatggcccagaaatcagaacagcttggttctaacctcatccagggctgttaagataatattgaggggagggctccattagagggaagatggagggatgtgctgcctcccggaaaagacgccaactggcctcctctggcccactgtcctttgtgcctttgaaaggaaacgggtgtcctgtgggtagttcaagaaaatgagcccttttgtccacctcctcatttcctgtgcagaggcctggacacctgagctcaggaagcactggactcactgaccaaaggggagggtccactctgtcccacacggctgactgtcaaaaagagaaggcagcagtggagggaaatacaatgctcccagtctgattttatttcctcttaaaaaaacaaaagaagctctttaagagttcatttgaaacagaacgagaagggaaaacaaaacaaaacaaaacagttccatgataggaacgtccatgactgggaagaggcatgagtgatgaaagttttctgtgtcctgatccggatggtaggatgatagtgactgggtgtgtacataggtacaagttcctcactttatatgttaaagatgtgtacatttaactctatgtaagttatacctcaaaaccaaaaacaaacaaaggtgactactccagaaaaagctttaaaaaaataaataaaggatggctgctgccagccccctctcccccatggcattctcctcttgaggttgtaaggtactgccctctacttaggaaaaaaccttggggtctctattgaacctgcacattgatatcgagagtgataaagtgatctgagcacacactaaaatagttcccgagaagaaagcattcacatttgggaagccaaacaaaagatttggcaggaatagcatgtagtaccctaaactaccagaaatatactatttcttgcccggaaggaatttcagctgagtaatgagtccctttgaggataagatcggtgcctcctggatgaagaggagaactgggttcccagtggccgcagtgcctttgcagtaggccagatgacctggatctgccacccaaggacttctctgccagagtcttatcctgtgttcttgctacacacaaaccaccataggagggcatcatactagtttgagggaccagaattttatcacatagccagatgatggaagaatgaacgagttttgtttacttgttaggggtcagaagagaaaatatgggcccagttataaatggactcctttcaggataaattcattacatctcttggaatttgtgaatgggagttggtccaagcgtggcaacgtcctcgggtcacctctgacatcacaccccatgcagaaactgggccttccctcacagaagcacccggtggggttggggaggggcagaattcagatggcacctccacagggactcctgaaagtcactcaaccacatcttttctgatgcaactgacttactttctgcctccatgtttgttaaaagtcccgccgaatttattccgactcaggatgagagcagcaatttcgggcacgtagcgggcaaacattgcctacatgcatgaaacaaagaaacaagagccaaaaaaaaaaaaaaatggcatgcagagaggattctaccgcagcagaggcagcaaaacctcttggcatacttactttcttccactaaccgcactataggagcccccgtatttcttgcggtttcctattaactctatgatttcagggacgtagctggcaaacatggcctgagaagataggagacagaagagagactaaaaagacaggccaaagaaaaggggggacctgttcagagggtgggggcactaagatctgaaaacacaaaaggattaggcctgcaaaggtatatattgatatgttggatcataaaaaactaaaagcacgaagagagcaagctcccagaaatacacaagacaaacaaacattggccaccttgacaactaaagaacaaaaaaaaatcacagtcgagaaaaatacaaaggcgacaggaataaataaggtgatatctagttcttcttgctgaagaaaaataggcaagagggggacatgctagtgaaactaaacacacacagacacatgtgtgcatgcacagacacacacagtttcgcaagagaagatcttcctttgtcattaaaattcagaggagaatcaatgcttttatgagtgacaaaagaaaataaacaccaaaagattaaaaactacatttttctattaaaaaaaaaaaaacactgaaaagctcaaaagggaaatttaggaaatcacctgggaggagaagatagcaaggagaaacacaaatctgccatgttttgtccaacaaacatctggcctgtggctggctggatgggtctttttatctataggcacctcacggatgctgtagaaatgcttgcgtgaatgtacacatgcatgtgcacatttatatacatttttaaaatgtataggccctatgcatacaaaacagagagaggtgtatgcatcactacatataaatgtgcgcacggtgtacatacatgaaagctgtgtatggattaggattttaatcactcgcttcataaatggcaaaaaaaaatctaaacttaaaatgagctactttgaaagacaaaatgcagcaactgccaacgtgtggccagaaatcccctcgatttacattagaaggggtggtttagtgcaacataaagagctgcgtagacttttaaaaagcaaacagtgaaactttcttagaagaaaggagcaaaaataccccatgtgtccgctgcagaatggagtgagctgtttgcaaaactgcactctgctcacatggggatgtccgcctggacaagactaaggtgctctctctcctttgatgtagggacccttctctttagggcaggccccagccacagtgtttgttggaagttaggggaggaacataaaggggaagggagagctcttgaaaccgcaaactgtctctacaaagtatcgacagcttctaccagaggcaggtgacagccactgtccttgtagcataccagatgctgagttacattgctaaggggtagacactctcccttattaacagcatcacttttcttaagacaattaggtttgctcctggctaaatggctgtccccgacaagggcaatgtgcctggatctatgggacaagtgtaatacaccaagaattatgcagaaaagtcaccatcgtgtttggatttacttagcctgattgtaacgttaaggcttgcttctagtgcagaatacagtctaaaatacaaagctttaaggaaatgtatcatggaaaatattaacagccatcaaaatcaacatcataataaagatttttttttaccagtcccccgaggatgaagaagaccatgaagaggcgcccaagtgtggtttttgcataaacatccccataaccaacggtggacattgtgaccatgagtaaatagacacattcccagtaggtgagagcctggttgttttggaaattttcccatgggtcccctgaattctccacctaaagcaaatgggacaggggagaaaaaagaaaaacatgctattgaagtgtatacatgcaataaacgcggaagctcggcactctcgaaggccacttgctactgcacaccactctccacacgagatgtgtggttcccgggctgagttctgtgagtcaggatgcagagctcctgagcaggacacagagaaagtggagaagcagctgcaggagatgtcttcctggctgattgagacagagagggaaagcaagaagggaaatatctctaggccttttctcttcttctggtaaaatgtgggaagccagctaaaattcagggcattgcctctggccaggttttagagcactctcttcaaggaaagagccagagattccgtccctgaccttcctcaatgggtttctaaggcccagatggcctggatctgcctctcccacagaaattctaaacacttccgtagggggctgcctccttccatcagtttatccaaagagtatatatgggccctgcttatttctgattcaaacagcatctctggaatctggccctgctctccctcctttgcaaattggcaatggtggtcccagccttgaggctgctggaatcttcacaggggcatggaaagtgagctcatgagaacagcttgcactggcacagcccgttagatcaagggctggcaaactttttcagttttgtgggcgacacaggtcctgttcaactctgcagaggcaaaacttcaacaaatgggtgtggctggatttggagagctttggcccgagactgcagtttccccactttcctgtccttccatcatatttgatctgccaacaaggctagtaggtgggcaggaaaggtactttagatactctcaggagagagggagctgcgggcccaattttactcaaatatgcctgtgatccacccacagggcctgtagacggtggcccccaggcctccacctctgcctctgcaaaatgtttccagggcctggcctctttcacacatcagtttgtcctcaatgtgccattttcacaaaagtttcctggtgaacctgaagggacttcactaatacccgtagtaaggtggggtcatcatcttattaaagacaactatctcctccacatatgtgatttgggtgcttcgtgcttggttacagcaagaattagggtgattaaggttgattttggccatgaatcccatcagcattaagggctgggcaggagactctagatctggtgactacgtgaggccccatgccccaaccactgccatcccaggcctgtcttcctttgggtgataattacctaaatcccaagtgtgggtagctaagcgcgtccttctatcccttatgcaaatagaggctcagccactggtggtcaactttatccaaagtctcagagctagacgaggctccttccagttgtaacagtctatgtttgcatgaaacacacttcccacaatggctgtgctctctaaaagcagggggaaagtctgccttcgggtggtgtgaggggcttgacttaatacaaggctttcaaagagtcactaatgaaaaagaatgaacatttttgaggtacaaatcagacaaaataatcaaaggtggcttttcgtaaggcggaagtggaaagaaattgagggatctgaatttgttgtttactaggaggtgtgggtccaacttccaaccttgtccccagaccttttccaggtgtttgcttaggaagcactgccatcttgtggcttactatagttattgcagacagaaggaaaatctaccaaagcccccatgacaataccaatgagcaatgaactgaaaaatgcaggttaatagtgcaaacattactcaccatttggaactagtttggggtaaaaaggttggaaacccagacaattgtgtggttgcttcccatcttcctgtctacaaccgaggtgaagttaatttccagcaagataaattttaggtaataaaatgactcagagagggtcttgttgcaggcaagcgagagcagaagggtcttcaaggttactcaccaaatggatgaacccggctgcagtcagccacgtgctgataaatatggagagcagattcaccagcttgatggaattactgtgcaagagacaacaagcaaaatccccacgttaccaagggaaggccctgctggggctgccttacagggtaacagcacccgcttagcaggagaggctgccacatctaactcccaaccatttctccattataagggaattctggaaggtggaggaagctgctgggatgaaggtcaggacagagcctagaggaacaaatttaactttggtaaaaattaacttttatttaaaaaactcttcaaatctacagaaaagtggaaagaacagtataatgaacacttgtacgctcttcatttagactgaccaattattaacattttaccacgggtgctttatctccctacatgctttttctcttatcccccccgcccttttttcttctcttcttcttgccatgtacatatatatatatatatatttgctaaaccatttaccaataaatcagagacatcatggcacaagccctaaatactttagcacccaactcctaagaagaagggcattgcacagcataatcacaataccattgcacgcctcagaaaattaaaacataaaaattcagtaatgctatttaatatgcagaccttatttaaatatctccagttgccccaaaattatgtttattgatttttttttattttccccccagacccaagtttcatgcactgcatttggctgttaggtggcttaaatccaactgtcaggaaacaaggacagagagtaaatattttaggctttacaggccatatagacattgtcacaaatactcaactctgtcactgtggcttcagagcagcttttggacatcatgtacaggaatagatatggctttgttccaataaaactttatttacaaaaacaggcagccggcatgggctatagtttgccaatcccagcttcagtcccttctaatgtataattgacaccactcctttgtaatgacattaaattttgtgtgaacctaggttgtcttctataatgttctatattctggatcctgtttatttacttatttatttttattttattttttattttttgagacgaggtctgactctgtcacccaggctggagtgcagtggcacggtcttggctcactgcaacctctgcctgccaggttcaagcaattctcctgccttagcctcccgagtagctgggattacaggcacccgccaccacgcccagctaatttttgtatttttagtagagatggagtttcaccatgttggccaggctgatctcgaactcttgacctcaggtgatctgcccgccttggcctcccaaagtgctaggattacaggtgtgatccaccgcgcccagcccagtttattttttaaataaatgttattgtgtatgtttgaggtttacaacatgatattacctaccatctcacatagttacgtttttgtgtgtgacaagagcagctaaaatctacatatttaacaaaaatcccaaataccatacaattttattagcaatagtcctcatgttgtacattagacctctagacttgatcatcctacatagctccctacttaagtatttctgttaagaatctcttcggggatggcatcacatcaggatatcccagcccaatgactagctccatccatgtggctaaggcagaaatgctaatgtctccactgagaggtgcccatttccctttgtaatgaatatgccaccttgagtgaggccccgagactgcaggaatatcctgctccccaaaaaccttatacctaatagctttagcattcactggtgttccttgagtggatcaactggaccttatgacattttgaggtccctaagagctgaggccttgtctgtctggattccaggagccctgggtccctggagcatagcagacccgtgactctgcactgagtgcactggtatctgcccctgctctctttctaaactgcatcctgttcagtcccactggggtatacctgaacgctgctgtcagcaggtcacttcactgtccaaaggcttcttgttgactaaaagatgacattcaaactctctccttccattgtcaacaccttgtgaagtcccagtctctcccaccacccctctttcacataaactcttgaaactgccatgccagctaaacctatttactatagctattgtttacactatttactcaacttgaaagcccttcccatctagtcaaatttccccattcttcaaagcccagttcaatccctactgcttccttaaagtcgttccatccatctgcaagacaaagtgactttccccggctctcaactccagccattcattggtaattgatcctactgacttaagatgtcttttgtaaagttttaggttgctatttgactcttgtgttccttgctgcatcttgcagaaaagaactctcttttctagctcttgcattttcccagtagtggcttaatgcagcctacagggttgcccaacccattagttttggtcagttcatctctgttatgactgccctctcttacctctcttttggagaaccaatgatttaaattctaggcatttaagatcacagtaatagtttcagctagcttgtttacagttctttcccagtgctcaccacatgtgccaccatcctaagtgctttaggatcacctgtgctttatgtatactaagtcatttaatgctcataacaacaatctttcttcttctatggaagagcacagaggaatccatagtcttagtttttccagagttgattctgacagttcatggaaagaataaacagattcaactttgtgggtgagactgatatttcaaaatgtgtggaacaactttcttctggctcgaaaacttggaaaaacagccaaaatgtccattctgtctctcttggtcatttctagagttaccagattataataattgccaatatttattgagcccttattatgtgttagatgttgtgttaagcagaattctctcctgcctgtaccttgtaagtcctctaaggtgtgctcccacattggagggtaagaaatagatgaagaactgatagccggcgacaaagggaggcctcttagggaggtgtgtgttgttcattttctcagggtatcgttaaataccaagtggcttcacttacatactcctggattcttgggacctgaacacagcagtgtcccaccaacaaccatgtagagtcctcttgagatattaaacctatttagagtctgagtctccttggtgctttggaaaaatgacctaaatatggtgattactaaactctaaatgatggttacagtgatattagtagtgcgttagggagctcttgccatatgcagaacatttaatcattgttgctaaaacagtccatgtttagctctgaaatctgattatttttatgacatcagtattatcacagatccctaggtttaggaatttgctttctaaatgaaactgtatgaccacacatctgaaagctacaagcaaaagatgcaaggttaacccctggtgggcattctccacagtctgaaatgtgaaccttgccaggttaagtagggctccttgggaagaaagagtgaggcacgccaggagcagggctgtgtgctctgcatagcaaaggttatatatctctgtgtggagatagtcatagccttcctggtcaagcccagggatctgggccaaacacgaagctaccagcggttagaatgatttgaaccattcagattctagcctgcttcctaagctttgagggagattatgatcttatcatcaacacctgatccaactaaagtcaatcattctcatgttgcctatacaattcctgagtctccatcccatgagttctaattcacatcgatggacacagtgaatcatgataggtcaggcacaggattcttgtagattagagacctcttccaagaaactgtggatgctgcaagagaaggtctggctccagagattacagctgtaaacccagagcttctggggcctcctttgtcctctatatgtttaacaagacatgtttcagttaacacagaaaatgccatgcactttgtacaaagaagtgtacgtttgtccctgttctgcttgtctctaatttttctctttgtttctggtactgccaggtgctgctggccttgtttgttttactgctctctttgctggacagatgtaaaatacccaccccctaaaaagttaactggactgcaccacactaacataaatggtctgaatgacaacatgagtggaacaaagtgaaattctgccaattcaatcccttaattatctctagatcccttcttctttctctgccccaatttgcactgcctaaggccatgccctaatacctcttccctggactactgcctcctaattggtcttatggtctatgaggtctttgatgcttcaaccccattctctatacaactgttggaatagtggatctttctaaaatgtcagtctaaccacatttcctctcctgattaaaatccttcaacagctctcatttgttctcagtaaagtccatgaatctaagaacctgcatgatttggcctctccctgcacatctcttgcagtctccatatagaatactcttctttacaaactttatcttggagccatttctaagttcatgtcagtagtaatgttttagtttcaaaaacgcctcccaaaaccatattggttaggtacacgatgactcatgcatatcatggaatgctatgtgagaaacaaaaggtgacatagtagatgtaatcattatctcaaagtagtgtgatgtggaggcaattttactttatcctatgtgattttgtgtgttgttgcaatgtttaccatgaacatattttcaaaattagaggaaacaggctgggcacagtggctcacacctgtaatcccagcactttgggaggccaaagtgggcagatcacctgaggtcaaaagttcgagaccagcgtggccaacacggtgaaaccctgtctctactaaaaatacaaaaagtagccaggtgtggtggcaggcacctgtaatcccagctactcgggaggctgaggcaggagaatggcttgaaccctggagacggaggttgcagtgagctgagatcacgcccagcctggacaacagagcaagagtctatctcaaaaaaaaaaaaaaaaaaaaaaaaaagaaaagaaaagaaaagaaaaattagaggaaacaataaggaaattcccattttggaaaaaattgctgagtgatccatgttttagtcatcaatatttaccacagtcaatgagatgtggaattacagcctttaaacacagctgctgactttcctctgacagtagaataagtgttctagcacctgtgtgttagatctccagtttgcagggcaactgagaaactgccaaaacctcagatagtgagagggagtctccttgtctcccctttaattggccgtttcaggctatggagtattctaggccccctatgggcttgcagtttgggaaagggccctgatgctggtcacataattgtgatttgcccatttcatcccatgcactttaattttccttctgctgcattcttaattctttatcaatctttctgcccaccttatgcttctctgccttatttctttcagctcttggcccagtgaggcagccaaagtactggaaatgaaacagcaactccaaatcattatttcaaattgcattgcaaagcctccatccctgcctaatgccacagattggcaggaattcaccgccaaagagagccagacaaaatctccctaaagacgattacatgggtcccccaacccacccttctggaaggaccgctatgaaagcagcagagtatggaagagtcacaggagaatcgctcaaaagtccaaaaccctacaaaagccaaggctgcactttctctgggacagaactttgggatccacacttggggatgcccaaaaggaaggagccaagattagccaggctggcacctggagagagaatggcctcagagagttgtcctaaagcttctagatttcttacaattacatgacgtttgcttctgtgcctggtgacctggcctttcctaccctcttaacctcatcctcctctttccatcacagaacgcttaatgtccaggagtgcagaattacccaaagtttccccaagtgttatgctctcacaccagtgtgctgttagcatcttccttgattagaagtcaacccccaccctacccctcacatgcccagccccatgaggatgacacttttttctacaaggcttacctaaaagtaaccttctcctcgaaaagatccttgactgccctgcaactcaggctaagcccagcttagttactcccctctcaacccctgggcatgctgacatcagcattaaccacaccgtcaggtggcctggccccctacgcagcaagttctctgacagcaggactcctagcatgcaccttgctgctgataccaatgggtgctcactccaggcttgctgaattatctcaaccatctggttatgaccataagtgaaaggaactctgaaaacccaggttgtgggtttgtggcaaaaagcaccctctaacaacaagagtttcatatagtgggaagtggggtgctggaaaaaggctgttttggggcccggatggcagatgcccagacagccttccaccccgtgactcttccctagggccattctctccctcgtcccctggctggctgcttcagcttccccgctctgcactgagagaggcagcactgagtgcagttggcaggtgagctgacaccagggatcccacagccacttcccgcatccaaaggaaagagaggtgagtgtcctagcagaaagtcagaaaaagatattcagatggtccatcattttctcaagttctaaaacggtccagggagtagacagtattcctcagagcaatggaaccttctcaaaatgctggcatcagagaataaaaatccccctaacatatgatgtaattgtgaaacagggagagacagacactacccaatgttagagagtgtcacaaaacaccatccctaccaaaaaagtaagtgtctcttaaggacaaggctctatgcttggtgctgggtactcacgcgttccatctttaaaacacagtctagtggagtgaatctgacatacgtaaatattggcgagatgctagcttcattgatcgtttacatttcaaaagtaatatgattctagcacatagaagaataattaaaaggcagaaatcaaggttattggcaatcagaaaaacatgaagaaatacaatattcactgtatgtgaataatattacattattgctaataaacagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcaggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaacctcttttattagtttattcatcaagacagccttggtttcaggccagctctgcaagccggcaggtcatcaggaaagggatcctctgggggcttttcctcctggtccagttgtgttttccagatcataacgcagttaacagaagtattcatggtgcattcggcaggaggtttgtaggttttcccccaaaaggcaattcacagagaaagccccaagggctatacggatataaagtgaacatctaaaatgtgctttgaaatgaaatgattttctgtttgccgtatgaggtttgtgattgcctctcacagcattgcttctattgcctttacgactgggttcaatttcttatttagtgatgtaataaaggggcgatttagaatctggcagcaaggacttcccaatcaatgagcaaatctatccctcattcactgtgcacctttccccttgacaccgtggctcttatctgggcaaccccactgggcacacagatatcagctatgtgtccctaaaagtgtccctacttccctgcatgcacagctatttctctcttttcaccacatagttccctggccctgcagaagagagcaactcaaaccctactctggttttctctccctctctgtgttagatcactctttctgtgaataatataactattaataatgtcattgtgatgaaagcaagcacacctgatatttgcaacttggcataggggactggaatgaaaaaaatatgacgaagaacatcttaccttgttttaagaatattcagaaactgcaaaatttctgaaaactgtatcagtctcagagctcttaaaaatctcaaacctggaaaaaagaatgaaatagagatgcattattttcaatgtgtgattttaatgttcacagtctgccatttgatttacagttcccaagggtcgaagggatgggaagttcttgcagaagataaaccagctggtacctcagacatattccttcattctgattcttgactggtttaatctcgactgggaaatggactttctctttataaaggtggcctgtttggaacctctttagaggaagggctcatggggagaagccaggttaatgagacttttcatttggtgatctctgattgaaagcactgtttctaagttacctagttatctggcaggattttgtctctgaaaaatcctaggaattgtgatagctcagggtaacccttgtgctaagagcagattgagaataaatcggataaccttatgtctttgatggattttattttttatctttatcttcagccctgataaaatgaagagtacagcccacagtgttatctgttttctacaaacttctatattttcctcccaataaaaaaaaaaaaaagatcagtgagatatcacaccccacaacttcaggattcaaaatttatatagttccccttttattaagtgttaagataaatggtttgtcctttctaaatcaacaacctctcttgaatgaaaaagaagcatcagtgtttaggtggcagaagagagatggagaaggaaaacacatcaaggacattttaaaaatgcaaattattatgttttaatagctaagagtgaattatatttctgttcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcacagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataaaaaggctcacggccaaaagcacagttgtaactgagctgatgaaaggctgacttagcaccgctgaaaaccgaccacggcgcagagtacaaaactaagaagtcacctcagaaagcagagaaaatatgagaaagggagaaaaaaaaaagatgaaacttcagaaaatagaaacacagtagaaatcacagagatccaacccatggataaaatgtgttggccaaagggaagtcaaaacatcacattgatcataagcaaaggccaggacataacagaaaagaacttttgagatatgaaaaaatgactggagactaaaaggtaaaatgaaggatcagttcttagagaccaatgccaagaagcatctggcttttcattttcacatttcaagtattaaaatcaagcaataaaaataaaccaccagtgttgatggggttatttaccgttaatgtaactaagatcattatatttaacaaaaagtgttggccgggcacggtggctcatgcctgtaatcccagcactttgggaggccgaggcgggaggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgtacccgggaggcggagcttgcagtaagccgagatcgcgccactgcactccagcctgggcgacagagcgagactccgtctcaaaaaaaaaaaaaaaaaaaaaaaaaaaaaaaaaaaagtgttaaacagcaattgggcaattttcagaatttttagacaaacagaatttgacccaagatttttatacccagtcaagtggttgttcaagaataaaagtaacaaaaaaaatttcaaattctaaggtctcaaaaaatacattgtttgctcagtgtgtgcataaagtttccaaagaggttcacaagacttgctaaatcagaatgggagggggcaagggctggaaattaaatttataacagactctactgctggtcctaaccttccagcccaacctagactgttatctcataccagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaatatgtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaacattatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgccacatttgagtgagttacacaaatatagtagaataaaagcttttcttttaattaaggtgcatgaaagtaagggcaggaaagaaatgaatgcagaggccacaaggtcctatactcttgctagacacaaactgcagatctagctctgagcaccttcttaacaaaagcaagcaggcagacaggataagatcaatagtgtatacatatgagagaaaaacaaactggcttgcaggagaatcatttatttttcccaacatggagaccagagggaaatatctccttgcaaaagggacccagggtgatgcaggagcaagacccctgtgggctgaacaagggtggcctttgcttatttgactgcctcatactgggcatttttatggcactgagtttcactaatgcaaatgagccaatgaagttctccataggttaaaaaagtcagtctacatttcatcctcagatcaagccagactatctggagaaatggttggtctttcaggaatcattcacaatagcttccgtattagtccgttctcactctgctaataaagacatacccgagactgggtaatttataaaggaaagaggtttaattgactcaattccacagggctggagaagcctcaggaaacttacagtcatggcagaaggggaagcaaacacatcctacttcacatggtggcaggaaggagaagtgttgagcataagagggaaaagccccttataaaaccatcagatttcgtgagaactcactatcacgagaacagcagcatgggggtaactgcccccatgattcaattaccttccacagggcccctcctacaacataggggtattatgggaactacaattcaagatgagatttgggtagggacacagccaaaccatatcagcttcctaaccgctttctgccctggaccccttgtgttctctgctcagaagcctccaatgccacccattccacacagagtaaaagtcaaagtctttcaaaggcctaaagcaacaccatcccaccaccagcactatctccttttggatctgatggcttcctactgtcactcctactactgtccgctgatctggcagatgtcttcagtgacacttgaacacacaggtatgctactgccccagggcctctgcacatgcagcctctctgcctggaatgctgtttgccagatgcccacatggcatactccctcacctcctttgggttcttactcaatgtcccttgatcagcgtgactttccctggctacccgacctaaacatgcaactcctcccacaccacccgtgcaactccctatcctctttcctgcttcacttttctcctcagcatgaagcactagcacctcggttatgtggttactttctgccttcctctctttagcatcagctctatgaggggaggagctgatgtctgttttgttcagggctatatttccagcattgaacatagtgtctggcataaggtgaaggctcaataaatccttgtttgaactgaatgagtgaatcaaagttttgagaaataattagacggcggagttaaaggttagataatccacattcagaattctgagactatatgttgcctactaaagggaaaagccagaagccctgcggggtcccctgagagaggtcagggctgcactcttgggaagtagaaagtagcctcatcagggaaaagccttaacgaatgaccactctggctatacccagaaagagcccagaagactacagacagcgacttcaggctaagagaggagaccaagataagagaggtgagagggggaactctttggtgacaattattcatcttctctattttataatatcttttattatttttattctataaaatctctgaaataaatgattttctaaggtaacacaaaatagctataatagagttgtgaagaagaaaatgtgtatataccaaaagccaggaattacatgccctccccaaaagcttccaggttcagagagttttacaagtgagatttttacagtttcaaaaaatagtaacttctctatctattctctattatatgatcaattcttaaaaatggacttatctgtgtttttccatgctctgtattggtttagaaagttggcattacctggacacaagttcccttgcattttttcttaaatggcaagcttatcacactaatgactaacaacaataatcctaaataaaatactagggtatcatatccaagactgcattaaatgaataaaagacatgagctatagcagatgctgtagggtacagcccaaatcccctcttcagggaccttatttgtcctgggctcttgaagagtgacctgctaaaggctcagagctagtcccttcatgagaactgccctctgctacaaggagctgcctcacctggggctacatcccctgtcagtggtggtgccccccacccccccaccccccccccaccaccacacacaaatgctggctgatgtagggacaaaggtcagctgccttgcctcaatttgggatactttttcctgtgggatgggttgaggcttcccaggcagctgcagccagcctgagttctccacccttattccctcacaggcatgggcattaaatcctaccctggtgatctgcataccagaagaccgagcattctaagagtccatgtgggcatactggaggcactcagtaaatggtaatttcatcatatgaagaattacaatagcgtaggagtgtacacacgccacagaaaagtcatcaaactggactagaaagcccagaaacacacacacaaacacacacacacacacacacacacacacacacacacacacacacacacagagtacatatagtgttactattattttaaattactggtgaaatgatgatgttgacaatgacattaatctattattattgatgatatctagtatgtttatttacttacacacactaaaacttctaactatatcttttttaaaaaatacgtacacagaagaaaatagctaaggagacacaaatgagacagtgtatccagcatagtttgaaagcaacagagccaagtttcaccacaaatgtgacaaactccacaaagcccaagcttctagccactgccctgtacagacttcagccagtcatttccaattcagacattaggactcaagcacacactttcaagacttgtgatacatcttaccaacttgtcctcacaatttgcattcccttcagtatgcaaatgctcttttgcctgtattcccactggattgagtacagtgatagagaaaataggaaggaaggaaggaaggaaggaaagaaggcatgaaggcaagaagggagagaaggagagaaggcaggaaggcaggaaggcaggaggggaaagggagagaacgagggtaagaatcccaatttgaggtcgggcatggtggctcatgcctgttatcccagcactttgggaggctgaggtggactgatcacttgaggtcaggagttcgagaccagcctggccaacatggtaaaaccccgcctctaccaaaaatacaaaaaattaaccaagtgtggtggtatgtgcctgtaatcccagctacttgggaggctgaggcaggagaatcacttgaacctgggaggtggaagttgcagtgagccgagatctcgccactgcactccagcctgggctacagagtgagagtccatctcaaaaaaattaaaaatttaaaaattaaaaaaaaaatcctaatttgatagaccccaaataagagctcatggctgttttattttgcttttctatcttaacaaatgaagctaattattttttcatataattattagtcattttattttcttctctaaagtgctttagagtggcctttgccagtctgcctgtgtatttatcttaattgtagtaatacaattatgttctcatataaagaagattttgtataccatatattatctcccaccgttcgtcattcttctcaatttggcttaaagtatttttcctactgtcaaattttacttaaggtgggtttctttccccatgaattctaaaatatatcaatctttctaccatgttccctttttttaaaatttttttggccatccccatcatatagataatttttttttttttttttttactgcatctatttttttttctttgtacttttggggcactggttctggactttgactgtacatttaaatcacctgggaaacttttagaattgttgacacctgggtctcagcaccccctacctgcattctgatttaatgggcgtggggtacattcaggcagagggagtattaaggctccagagtgattctaatgagccatccaggttaagaagcattgcaaactttttctataaatgaacatatagtaaatattaataaatattttaggctgtcacaacgactcaactttgctgtaaataataggaaaacaaataggtgtgaccatattccagtaaaatgttattcatataaataggccatggacactaattttctacacttgctttggaggcatgggattcaaatccattgtgcacatgaatcacctggcatttgtaaacatccagattctgactcagtgggtctccgatggggcctgatactgtgcatttctaacaagctctaagctatcgtcaatgctgttggtcagaagaccacactttgggaaaacaaggctgcaaggcagtggtccccagatttctctgccattgcaatcacccgaggattttaaagcaatactgaggcctgcttcccaccagattcaacgggtctgggatacaagctgggcatcagaatttttataaattctgattcgagtgtgcagccaagtttgggaaccagtggttcagaatatattttcttttctctaacctttaatttgttaatctgttttgatgtatttatttattttggttaacagtgcaccaaaaggaccaagctttatttttctaatcaagaagattctaatgtacagccagatgatggatgaggatgagtccagtgtacagccaagtttgggaatcactgctttagagtatcttttattttctttttttaacctctaacttgttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataaaagattatttataaaacaaagcattcagcttaagattttgggggaaaagtagtcttgacaataggagaaagctgattttttagttcagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaactgttccataatacaaaacgagatctaaagctactaacttatattataaaataaacataaactgaggaccaaaaactgactctcaaagcacaaaaataaagtagaaatggccctcaacttacaatggttcaacttaatgattttctgacttttcagtggtgcaaaagtgatacctattcaccttaaaccatactctaagtattcacacaaccattctgtttttcactttcagtacagtattcaatacattacactaaattttcagcactttattataaaatatgctttgcgttagatgattttgcccaacagtaggtaatgtaagtgttctgagcatgtttaagatagggtaggctcagctgtgatgtttggtaggtgaggggtattaaatgcattctcaaacttaaaatattttcagtttatgatgggtttgtgaggatgtaactccatggttaaattgagaagcatctgtattctaatatcactaagatcatagatgccaaaattctgtatataataccaacataaattattcatcaatgaattaaaatgataatccagagcattctagttaaacatagcagatggatcacaatggtttatgtctgccccctctcaaaacttcactaaactaatacaaatgttgagggggtaggaaacagcagaatcccacaagaacaaaaagaatggaagaggagattacaacacagaacagacgaacacaaaatgtgggtagatactctgttagaaactgacttggcatacatatatatgtatttatttatatttatataaacatatacatatattttccatgtatatatttccataatgagaaagaaagacatatacacacacatatgtctatctccacaatgataaacagaatattaaaaatgtctttggtcaatacataaagactgaggttgatgggggggtggttgggatgcagagatcacagtgaagaagaaaacaaccatccaaaaggtgaaatgaagtggctgaccctgggaagaaggaggctgtgacaataacactgattgactggggtgccaaacaggagtagtcactacatggcagcaagtgcatacacttgaggtgttaaaatagagcaatatcctgagtaaactgtaactcttggaagaaacacactgtctctacagctgtaagaccagttaccgaatagaaacacacagtagcatatctcagtactccccagacaaactgcaacacacaaagacagcattcacatataggctaacagaagatctcaaatgcaaagataagcacaaaacaggccaagcacggtggctcatgcccgtcatctcagaactttgggaggctgagcaagactccatctccaaacaaaaaaacactgtcaagtacatctacatataaccacatggatgaatcacacaggcgtaacactgagagaacaaggcctgacacagagtcattctatataacccagttatatgaagttcaaaactgggcaaaactgatatatggtcaggagagtggttacctttgtggggtgtagtgactagaaggttgccaggagaagggactagggggtgacaggcaataatgactgtttcttgagctgagcgttggcttctcaaatgcattctcttcgtgaaaatttatccagctgttgccaggcacggtggctcatgcctgtaatcctagcactttgggaggctgaggcaggcggatcacttgaggtcaggagttcgagaccagcctggccaatatgatgaaaccccatctctactaaaaattcaaaaattagctgggcatggaggcaggcacctgtaatcccagctacttgggaggctgaggcaggagaatcgcttgaacccgggaggcaggggttgcagtgagctgagatcgcgccactgcactccaacctgggcaacagagcaagactcggtctcaaaaaaaaaaaaaaaaaagaaaagaaaagggaagaaaagaactaaagaattgccaaacatttgaggaaaggcaactttccttcaagaaatgcacatattacacttcaggccaactgacccttaaggatacaacattaacaaagcattaaacaaaaaatgctttagaaaaatatttgaaaaatataaagagttgtgaaaaactatctcaactcaaaaaatcaactaaatatcttagcaattaaaattttgaacatcaaaatcttaaaaggccagcttaatagaagaatgggcatagccacacagcaaagtagagggctgaactatcacacagccatcttcatacaaaggggcacaggaatgaaaagtgcaaaagaaaaactaagagacccagaaaacaggaataaagttttccacatccatgtaattgagctgccagaaggaaaaaatgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcaacaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaaattaaaatctctggaaataaatggaagatggaggtgtgaaggagagagggcaatgggaaaaagaaaggtgtgcagaaattcttgtcttgataggatacaatcaatcatatatattaacagaaaaaaattaaagtatgtgtatcaaaaccttaaggatataaattccatagcctagagaaaaaaaaaaggacaaaggaatttaatcaaatggagaaaagaaaaaaagaacaaaaacttcagcccatccaatgaaaagaaaaaaaaaataaaaggtatattaatcagaaaacatagttacaatagcaaaagagtccaaatatatttgtaatcataataaaattaaattaaaattactttcacctatggaaagacagagattcacatgatatgaaaacaacaacaataataaattccaggcgcatgctatttaaaagacatacactgcaaacaagacatacagaaaagttagaaatgaaagaatggaaattatgtgcctggcaaatgctgagaaaagaggaacaaatagagcaatgactatatcaaataaagtggcagctactgcaaaaagttatataaaaattatatataaacattatattaaaaagaataaaaagtaatatctcatattgataaaagaaacaatccacaaagaatgtgtaacaaaaaaaaactttatacacctaaaagtattcctttgagataaataaagcaaatatgacaagaatgcacaaatataggacatttaagtagcatttaatcccttgggatatattcgtatctatatgtatctgaatggatgggcagaaagacacacacatatattagtaaactaggaacacacattctttaataacagccatgagcagtctcaaaaactgaccacatattaggccacaaagaaatttcatcaaaatctaaaatgcaaaaatcatctaagtcacatttaccacaaagcaatagaataagaaagtaataagagcatggcaacaatgactaagcagtagagaaatagactctattttatcagaagaattttacagacaataaagaggtcatcacaaatcaaaaggaagacaggcatcatgcaatgatggacctcataccataatggaaataagtttgagatgaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgtgcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcaggagatcgagaccatcctggctaatacggtgaaaccccgtctctactaaaaatataaaaaattagccgggtgtggtggtgggcacctgtagtcccagctactcggcaggctgaggcaggagaatggcgtgaacccgggaggtggagattgcagtgagctgagatcatgccaccgcactccagcctgggagacagagcaagactctgtctcaaaaaaaaaaaaaaaaaaaaaaaaaaaaaaaggaagaaagaatcaacggagtgaagagacaacctacagaatgggagaaaaatatttgaaaactatacatctgataagggcttaatattcaaaatatatagagaacacatctcaatagcaagaaagcaaatagcccaattaagaaatgggcaaaggacctgaatagacatttcgcaaaagaagaaatgcaaatagccaacagtaaatgtttaaaatgtttgacatcactatttatcagggaagtgcaaattaaaactacaatgaactatcacttcacatctgttagaagggttattatcgaaaagacaaaaggttaagtgttggtgaggatgtgggaaaaaggaacccttgcatactgttgatgggaaggtaaattagtactattttccattatggaaaaaggtaaaaagtttccacaaaaacccaaaaatagaactaccatacaatcaagcaacctcaccactgggtatatattcagaggaaatgaaatcaacgtgctgaagagatgtctgcactcccatgttctttgcagcactattcacaatagccaaggtatgaaatcaaccgcagtgtccatcaacagatgaatgaagaaaatgtgatatatatacacaatggcatattattcagccaagaaaagaataaatcctttcatttgcaacaatgtggatgaacctaaagtttatattaagttaaataagccatgcacagaatgacaaacatcacgtgatctcactcatataaaacagctgatctcatagaaagaggggctggggcggttggagggaagggtggttgggtagatgttggtcaaaggatacaaaatttcagttaaataagagaaataagtttaagatatctactgtattacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattccattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaattaaaatagcgattaccaggagctgaggggagaggaaaaattatttgtttaatgggtttagagtttcaactttgcaagatcaaaaagtactggagctctgttttgcaacaataggatatacttaacattactgaactgtacactaaaaataattaaaatggtaaattttatgttatgtgtttttcaccacaattttttaaaaatagcaaattggaaatgctgaaaaaaaaaaaaaagaagtaaaagatgaagtgcatggtccctatgataaaactatgaaaactataggtatgtgtaaaatgaaaaagtagaagaaaagcataaaatgatgacagtggccatgttacaaaggcagacattttggatttctttaatattcttgagttttttaatttttttgtaatatttatatcaaaatttctatttttatgcataattacttattgctgtagtcataaagtcagtggcaagtcaggactggaatacaggttttcctggctccgagccctgtactcacatgcaagattcagtcacatgagaccattggctccaggtgaggaggaccccctgccagagctttcccttcgaaacttgctgcccagggcctgaacaactaggtgaggctcctcctgagaactattgctgtggaattttagcaatgaccagacagattaagggatcttgaactcccttctcagataaaagcagagttactgtactgacagaaattgagggataaacaggtaaatgataactcattcactgcttcagggttcctgtgatccccagagagaaaagactctggagattcatacatgtgaggtctcgggagaggacaagacagaaaacacaacagcaaacacatccaagcccataccagaaagcctgccagggttttccaatttgctattttccattccctttcactccttaatctttaaatccaaaaagctgaaaggttccaataaacgtctgtcgtttccaatctctgcagccccacgcaaatcctgaagagcaattatttttgtggtgtctgacaaggtcattgttatctggccttgcagctcagagggatcaaactgagggcaggcatatcagggtaaacagaggatgcccaggagcatggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcctctcaaatgcccctgggcttttgttcccacagtcagaatgtgtgttctataaacagttcttgcttgtctgaccttttcaccatcctttcctttggtaattgttcaggttgttttgctccctacttttttaaaaaaattttttgagacagggtcttactttgtcacccatgctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacacatgcacagagtcactgcttccaccaccccttgtggttccagatgctgcagcacaggggtgaggctcctgcttccaggtcttctatttgaatagaggagccagtaagtagagaaacacattttttaaaagtaaacaaataggacttactcactttacctctttactttgttttaaaattattgaattttttaagagacagtgtctcatggtcacccatcctggggtgcatgatcatagctcactggagtcttgacctcatgggctcaaatgatcctctcacctcagcctcccaacatgctgggattataggcataagccattttgcctggtctgactttacatcttaaatatatgtgaaataacttatcttttccctctccactgccagaaccatggttcacactgctgttacctccatctggaccaagagccccacacgggtcttcctgcttcacttctctaccccagtccccccaggccccaccagcattctccagaaagcagccagcatggtcttttcaaatatccatcagattacattgctccctgccaaaagccattacatggcatccatctcactaaaattactttcagattccttatctcgctctggaaggctctccatggtttctgctcatttcatcaccactctccatgtcctcacgccctgcacacagtgtctctgctccagaaacatttcccagttcgtcctcagctctgagtcttcccttctgtttcttttcttgggaatgttcttcccccagatcattgcaaggttggctaatggaggtcttctctgaccacccgatctggagcccagtccttcgccgccattatccattcttctttatagggtttaccacaatctaaaatgatctcatttgcttgttcaggtgcctgcctcctgcccgttcctcagcagactatctgctctattggggcaggtgtctcactcactggctcactaccaagtgcaccctcttctagaacagtgatgactggtacatagtgagtactcactactgaaaattaataaatgcattaatcctttcaaaggaaaagtaagaagggtattggatactaagttaaacccatggttttactcaattattcaacgttttctcaggaagtagtgtatgtgcccttagcttaataattccatcatttggtctcttctctctagtggctttaatcctgattctctccaaggccagatgttacagtacagagcagctcttctctgtgatgaagggagaggaaatataacaatctggccagctaattctagggttatagacacagaagcatgaatatttagattccaggcatttcagctgacagaaacattttatatcagttctaatgaaaaggattgactaggtttcacttattgcttgccaactggaattttgttaggcacaattacataatgcagaagtatttgagctgtgcctacccacatcagaatcctaaactaggtttcaaagggactacattccattttaaagaaattcctagtactgctaactttcctggaaataaaagctatccctccctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaataacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagacggaaagcactttttttcccaggcagcctccaggaatacggaatacttttgggaggagaagagccatggacgggtgagtccttaccccaggatgcacaaacaccacagcaagacaccaatgactgccggaagttcggcggttcctccttctccggagcagcaggcccagacttcacccggtagccattatggaacaggtcccccagggacttcttgcggcgcctgccgggtctgtaaagctctgtgccggttctgctggatgggtggcggtacaccagaatcttactggggatcatggtagaaggagggagatgggctaggctttcggctcccttccattcacttcttgcaggagtcaatgctctggaaagacctggaggagcctgtgttcctctgacccgtgctgcaaacaggtcctcctgtccagcgcagtgtgggtcaccagcatctatgtcctggtggagccaatagacactctctcctccctcaccctccagtccctcttgcaagaaccccggcatgctctgggcactggatgcacgcagccacatcagaaaggcggttaagaggggcgggggaagcactctgatccacgatgtcctgcgagctgatcaatcagcttcacgctggaaataaccatgtaagctcctttggacatggtttagggggatagaaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctcccaccactaacataacccaaatacgcaaatcctctgctaatcctacatacaggactgaggaagaagagggattctgggctatccagaggaagatgggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagtgattaggtttagacaagatcatgaggatagggccctcatgatgagattagtgccattataagaagagagaccagagagtttgctctttctccctctctgccatgtcaggacacagtgagagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatccccacctattttttcagacctctagcaaggctaaaattattggtagaattttcaaagcataacatttcttctcaatgtggattagttcattcacctgaccatgacgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgagaaactaactctccaacacctaaagttgtctggaaatgatagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatatttatggtggaaataataccaatattacacaaactctttcagggactggaggaaaagagaacccaacttgatttataatgccagaataatcatgacattgaaacctaataagagtattatgaaaagaaaaaaaattacagaaaaatatatgtcatcaacatagacacaacaatccttaaataaatactagtcaaatgaatccagcagtatataaaaagaataatactttagaatcgagtaaatagagtttatcccatgagtaaaagattggtttaaaaaatgaaaattaattaatgtaattcaccacattgaaaaattaaaagacaaatcatatgatcattttaataggcatcaaaaaataatgaaactatgttgtgttaagataatgtgtcgtgccccccaaaaagacaagttgattaatgaaacagagtccagaaatagacccatatatatacaatcaattgatttacaacaaaagcaccaatacaactcaatgagaaaaataaagtcatcgccacaaatggaaggaaaaatggatatctacaaagggaaagaaatcagtctcaactcttacctaacacaatctacaaaattagtttgagatggatcactgacttcaatgtaaaagctaaatctgaagcctctataaacaaacacagcagagtgtcttgaggacactcggataagcaaaggcttcttagataggacacaaaaggcactcacatttttaaaaagactgataaattaaatatcagtaaaataaaaaacttctcataaaaagacaataaattaaaagataagccacagattaagaggaaacacttgcagtacatttatatgacaaagaacttacagaaataaaaattaaaactacaacaagatggcaccacaaatccattagaatggctaaaatttaaaagttgacattatcaagtgttggtgaagaaacaaagcagctggcaccctcacacgttgctagtagaagtgtaaaatggtgtatcttcctttggaaaactggcagtttcttgtaatgttaaacatgcatctatcctatgacccagagactcaatttctaagtatttacccaagaaaaaaaaatatatgtccacaaaatcatttgtacaaggatgttcataacagctttattcaaaataagccaaagttggaaacaacctaatggccatcaacagggtggtttgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatttttttatgttcaagggaggagagagcagatattgacagaaatgagcataaagaaacattccaggatagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatgcctaaacagagatcatctgctgtaaccctgtaaattccctcccaacttccagtgggcagtatggcatgaaacccctgcaactcagagatggctggtttaattggagaagtgaaggatttgtattcaggctctgccaccagcagctgcacatctgagtaagttatgtaactcctagcctcatttcctcatctccgaaatagggattatgacatctacttcacagacgaactatccagattaaagaaaacgatgtttgcaaagctctgcacagggtctgacactcagcaaattctcctccaaaaatctgccaaagcactagggcccagtcaaactggtctatattctgccatcgaatgccccatcatcactgggcaatctggtctcctactgtaaataaaaaccccacctatctccatggggcacatctgccagcctcttcctaggaccctgtaggtgtggcaataaatgtggtccctggaaccagcagcaggggatttggttcctggcatctccacatacgagccacatgctcttggaagttattccaaccctgcctcaagtctctgacttttaaaatgggaaacacttttcaagataaatctgttcatcacaagaaaggatttcttataaatttgaaatatttaaaagagaattctatgcaaacgtatgcacacatacaagtgaatgtgggcccatttctctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaatattgaccaagaaatgaactcagacgaaattgacctcttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacggttaaaattgtccttggcacataggaaatgttcagtcagtgcttgctataattattactaggagccagatactgggctaaccatattggggatacaaatgtgatttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattacccagtaagaaaaaactgtgccttgggttcaaatggatgtaagttttgaccctggctctgctcctgatgcactgagagaccctggctgcttatatgaaacctgaatgtctatgactgcatgtaaaaaataaagatgagaagctgggcgcggtggctcatgcctgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacagagcaagacttcatctcaaaaaaaaaaaaaaaaaaaaaaaaaaaaagaaagaaagaaggaaagaaaaaagatgagaattatgcctctcaggggctgtgacaataaattgatctacgtgtgttttaaaatgcctttcacacagaatatgctacataatcactcattcctggtctcctccagaagtccctgcacttggcctctctctctcgggtgtaatggattggtccccattgaaatacatttccttttcagagtcatttatccctcagttagaaagaagtattgaccatggggaagggggactgtgaagccacctgggcatggcagagggggccaggcacagaggagggagcacaaaagaacgaacaatgaagcacatagagaaataaaacctaactcgacttgcaagccagtgatggccctatttttagctgacaagtgagtaatctgatgtgtgtgacttgaaacagggaacataaacatcaaggctgaatctataaccagccacatataacttgtactataacttattcccagaattctagactgtttgaattaagtgtctgcaggtctcttcttcacgcacttactcttattaagtttgggaactagaagcctgtgtcatttgcacaggtctcaagttacaagggaaaaagatgctttgcttggtctctggtttgactattccaaagaatctttcctaatctccaattcgtctttgtctcccaccccaccagcctccctccctccttcccttccccctgaaagctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctcccttatcccacttcccatggtgagccccagctgggacgctgacacatggccccaacttttcctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttgccaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggtcaacctctgatgtagctgacatcttgaaatgaggaaggaatgtttaatttgagaacaggtacttctacatttcacaaggtagaaatctgtaaataacaacatttggaagttccttctgtttcctgcaacactcactttagaacctaatatcatgctatttttattgctctggcttaattcagttatatagaaatcatttctattcaaatagacgatgaaatccttgaggtcaaggtctctgtccaacttctttgggtataatccatcgtgcctagcacagctgggaactttgcacttgcttaaagtgttttcttccctttctgaaggacagtgattcacatctctgcttttgacatgcaaggacttgacgatctatttaacctaaggggagaagagtctctttcaaagaatggattgtcatccccttctccctgcccctgccatgtacattatgcttctaatcagtctggaataaagcgatgtcatgggcataaactaatttcttccaatccaaaacaagttagcaagtctcattttgtaattctaaagtcttcagctcatgtatttatttcaacatttttttcctataaataaatggctgtgtgacttgtctccttctttgtgttcatatcccaatgtccagtgtagagtggccttcactaaatatgtgtagaaggaatgaggaaatgaatgcaagatgggcttagctcataaaccctttgttttgttagagacttttgccaactcttttaggcagttacaatattttgatgggcaagacctgtgctgttgggctgcctggtcaaacccatgcatagtgaaataatccgtctccaatctcagcctgcatcctaaccccaatttgtccctgagtgcaaggtcactgatctgaatttgaatggcaggctttgttgacctaacaactctgttaggctcacccatttctgcatactactggtgagtgacagaggatggacactgaaatctccatcttttcatagaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttatcattagcaataagtggattctttcttcctgccacagacaaactgaggatgtaaatgaacaccatactcgcattgttgcttatgctgttgttcttcacccactgcctgaggtgtaggtttgcaaataaaatcaaaccatcattattctggactgattatccaattagagaatgaaataggccagccctgtcttccttcttcttccatcaaatgccattcttgtagccatttcactgacaacatgaggggccaacagaagaaataaacaggcataaatttcaaacccaggaaatttatgtgagcaaagggaaagaatccagatatataaaatgaattaatcatcaataagtcaccacatccctattacatggtaagttcttttctgggagctgttagggccagaaagggactgtaagacacagtccctgctttaaagaagtacaaacaatcaccaaaaataaaagcaaaactgaaaaacagcaaataaataatcatttatcagaaccaactatggactatggatagtttaaaagtgctgagagcatagcccacatggcagaagtgcataaataatgcaaaaccttacattggctgacaatttaaacttcccttcatgatcattcttctgtcagaaccgctgagagagataaagaagataataataacaaaagaacttcaagtttctggtgattctaagtaggttctagtttcaggagtattccaacacactatgttaccttagacaagtcatgttctctctttgtgattaggtttctcatcaaaaggaaggaaagaaggaagggaggaagaagggactgggagtgttggtaatagataacccttaatatcccattcagatcaaatttctataattataatgtggctctctgcctctggaggtcactcagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttctttctttccctgtctctctctctctctttctttctttccttctttctttctctttcttcctttctgatggagtcttgctctgtcaccaggtgggagtgcagtggtgccagatcagctcactgcaacctccacctcctgggttcaagtgattcccgggcctcagcctccccaagtagctagggactcaggtgagagtcaccaggcccagctaatttttgtatttttagtagagatggagtttcaccatgttggtcaggatggtctcgatctcttgaccttgtgatctgcccccccttgcccttctgaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatttctttttataaatgctaattgcaactcactaattaagagagatgttacactgggcaggaaaatcattgagtcaggaaatcttgcaattttctctagcatatttcatgaatcaaaagtcttgatctgatgcagttttttcatggcctagagggcagaataggagctgaataccacagcttctcttcataagggtggtatggaaatggactcccagtttaaaagagagtcaaatgtccatcctgggagaattagcagagtattgtggttaagggcagaggctttgaagacaggcctggactaatttatttttgcctatggtttaggacagagggtccaagactgtctttttcatcttgtcatctcagcatttaggatagcaaggggtacatagcaggtgctaaataaatgtgttgtgaaatttaagtcctggttctaccatgcataagctgtttcctagggcaccttccataacctcttggagactcttctgtttttttgcttttgtgtgtgtgtgtgtgtgtgtgtgtgtgtgttgttgctgttgtcattattttgtaaaatgggatgtctcagttggggttcctctgcaggagaacctgagaaaaggatttgattacaaatagttaacttgggaagtgatctcaggaaacaccagtaagggaacaggaaagtggggaggagatgggaaagcatccataaagagtttgttatcaagcatttatcactgtgggcaactaaaggaaaatcccactggggtactctggcagccaggatctacacatggctttatgtgtaaacagaagagccttgcgaccaaggggtgagggggctggggcattgatccaacacctcctgttggtcactggttgaggaggcattaagtccctagcacttacgacctgtagacaggcccacaagcaagcttcagtgactggagaaagtcctctggcaaagaaatgcagatgctggcaattcaaaatctagccacctgcactacaggtaagggcaagcgggtctgggttgcggtgacaggcaccaacagggccagcctcccaggaataataaaacctatgtcttaggttgatgtgaggcttaaatgaagcggcggatggaaaggactgattgcgaccctgcacactgtacctccattcactgagggcttcctgctgtcatgagaacatggaaaatgtggcgctccccactaaggcccctggagccatgcatcaggtagaatacagtctcaagggcatcttgagaccttatagatccagagaaatgccacttcctagccttggaaactgacaatgcacattagcatatggaaggctctgaggattcttatggttaagaaactctttaattaaatgaggatttcccaaacttactggagcacagagttctctttccaaataatgtatgccaactttcagtgtaatccaacactccatgaagcacattttgggaaaagaaggcctgagactggtgaattttacccagaaaagcattccataatttccagctcacccccaaaattctgctgacaaatatgtttccttaactacacccaaatcttctgatttcatcttctttttttctttttctttttgttttttgagacaaggtctggccctattgcccaggctggagtccagtggcaccatcttggctcactgcaacctcagtctccagggctcaaaggatcctttcacctcagcgtcctgcatagctgggactacaggcatgcacctctacatccagctaattttttgtattttttctagagatgggtttcaccatgttgcccaggctggtctcaaactcacaagctcaagcaccttggcctcccaaagtgctggattacaggcatgagccaccatgcccagcctcacctccttttttaatgaacccaaacccaccctgatgatttttttattctgcatttctcagattcataatggttttcacgtgtgatttgaaatcatttatgggagctgcatgagcaacttacatcctggagtttacaggtgttgcaccctgcccaaagttgctgagtgctcaccaagtcctgcttctctcagaggcagcattacctaatggacaggagtctccgggcccagctctgttgcttattaactttcccaacgtcatttgtaaaatgagaaaatgtctgttgttcacaggtgatatagttaggctctgtgtccccatccaaaatctcatcttgaattgtaatccctataatctccacctgtcaagggtgggaccaggtggaggtaattggatcacgggggcggtttccctcatgcttttctcgtgatagtgagtaagtctcaagaaagctgatggttttataagcatctggcatttcccctgcttgaactcactctgtcctgccaccctgtgaagaaggtgccttcttctcctttgccttccaccgtgattgtaagtttcctgaggcctccccaggcatgcggaactgtgagtcaattcaacctctttcctttataaattacccggtctggaggattccttcatagtagtgtaagaatggactaataccacaggttactatagaaattaaatgaattacagcacaaaacatccagcactgtgcagccaccaactaatgctcaatgaatgtcgcttgcctttcaaatttcttcctctaaccacccctagccctgattccaattcttcattacttagataattgtcatataaagagaaaatagaatgatgaaatggaaagactgttgcctgaataattcaggccacttagtgagtatctatatccatatagacagctgtgtagctacctctctacaggtaggtaccttaatatgcaatgtccatctgtatctatatagagatacagatatatagaggcagagatatttcatgcaataaatatttattaagcacctgctggtgcctggcattgctctgtgttggatgaaaatactgaataagacagacatgatccctgctcacaagtaggttacggcctagtagtacagacaagtcacatcaagaaacaactaaacaatgaagcaaacaaacaactaattacaaattgcttcaagcaaatgcttgtataaattgctataaaacacacaaattccagtgagggacactttagactgtgtggccacagaggcctttctaatgaggtgatagatcagtggagaactgaagggagagagtgggccatcaggggacgcaggggcaagtgccatccaaaggagcgggttgctgcctgccattgctgaggcagggagaagaagcctggggggtgcaggagaaggcagaagctctaaggccatggcaggctttatgggccgtaaggaggtcttggtttccatctaagaagaaggaaaaagtttaaagaggtgggccacaaaagcagattgaaaaagggttgacattttaaaagatccctgcaaacaactaaagaaaggagatgactgtgagattctcagagaattctttcctgcctgctattgatctccaaaaagtgtgattctataacaagagcaaacattgacagtgagtcagatacctctgtaatcatttttaaatcactcattttattcccacaacaccttacatgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatctgaactaaaacaataagaagatgctatgcaaaaaatgaacctgggtgagtactgaacactttaaaatgcaagactttactaaggctaaatagaattgaaagctatagcctcagaagagaatgtcacaaaaccctgacacagtgaaacaattacataactaagaagtgaggggaaaggatgggggagaaaatgaaatgtcattttctcttctttcacagcagaaagttcatctgttttacaccaaattaaaaaacaaagttggccgggcatggtggctcacgcctgtaatcccagcactttgggaggccaaggtgggtggatcacgaggttaggagatcgagaccatcctggctaacagggtgaaactccgtctgtactaaaaatacaaaaaaattagccaggcacggtggcaggcacctgtagtcccagctacttgggagactgaggcaggagaatggcatgaacctgggaggcagagtttgcagtgagccaagatcacaccactgcactccagcctgggtgacagagcgagactccatcttaaaaaaaaaaaaaaaaaaaaaaaaaaaagttaaatgaaaacatgactctaccttcatcttttctcctaattgctttctcatattcatatcagcatgtcttaggaggtaaaagttacaaagtttagcgattgcttcatttttctccaatttttctacattcaagtgaaatcacctttgcaaaattatgacaacaagagaaatctgacagagctgactccctcttgcttccaacttccaagctacccttagtcattcctgggcataggccaagctaactttgggaggaatttatagtttaacctttaagcaaggacagtaatagcccttcccaaaactaaattgtccttgtaaaactaacgaaaggccataaggttagggttataagaggtgcctgaattctgctaacacataagcgcagttaaatgataaccagccattgttctggaggtcacagatttgtaacttcctcaattactcttgtaaataacatcactactgtagaactgaagactggccctgggagatgtttttcagacttctggcatttctggcgagtgactgaccccacctggacccaagactcatgactcagccagtcctgtggtccccacccagaggactcaacacgagtggactgttttccatacgcttgtggttttacccccaagcaatcaacattccctgttccctagccccctgcccaccaaaccatcctgaaaaactcctaacctcctagcctttggggagactgatttgaaggataaccctagtcctccagggtggccagactcacattaattaaactctttctttacagcaatactgccatctcactgaattacttttgtctgtgcagcagacagggaaaatccactgggtgactacacaaataagcttaaacttaacagttttattttttaaaaaaacatgtaggccaggcacagtggctcatgcctataaccccagcactatgggaggctgaggcaggcgggtcccgaggtcaggaattcaaaaccatcctggccaacatggtgaaaccctgtctctgctaaaaaatacaaaaaattagccgggcatggtggcaagtgcctgtaatcccagctactcgggaggctagtacaagttcattttatataaatttctgtttgtctaacttatttacttatctactgtacagaaaaatatctagaatgatctttatccaatgtgatcaaatgttttatgatatttgctttggtttgttggacacattcttcttggcattttctgtgttgcttccatttctcttaaatgaatatgttgagttttttaaataataaaataattattttgaaaatacataaggaagacgtccagacttgctttacttgatcatatgaaataaactcctcttcacgctggagcaaaataagagcactcttatcttgggggttttggaagtatttctgtggtttctgggatgcaatatctcagccagaaaaataagcccttcatcctgccttcagcgaggcgagccccacagcaagggccaaagtctaggaggcctgagcatgaggctgcagtgtctccaagccccactgcctttaatgggaacagcgtcctggcaccctctccaggatcacagcagtgagctctgtcctctggtcacctgcgccaccaacaccctgacaaggtcctcctcctccttagcgatgggctgcctcctttcccacagcttctggtgcccccatgggttgggggcagggagggaagtagcaaagaattaagaatcagatccagagaagcatgtggtcatatcaaagaaggagtgtaaatagctcctatacaatgaggtgatcagatctctaagaggctcagggaaaataatcaggaataagtggaaagacagaaatgaaactgaacaaaagaaaacacttttagggagaaggaagtttgaggcaggtcatcatcctcaagaatcttctttgaggcaaaagagctgtatgccatgaggagaaaatgatacaggcagagcaagagaaaaataatgacctagtcattggctcaagattaaaagctataatagaccctttgatcctcacagtaactcctttaggtagtgaaggcaagagctcatctccttattataggtgagggtgataggattcagagactatagcttgttgctcaaggtcaagcagactggtgcaggtgcagcctggaccacaaggaggtctctggacctgatcactcggccatgggagtctcctctctctccccttcccccttttcatggaagtgagagttgtgtgaatctgatattccccatagtccccccctccatgattcctagtttgctcccagctcctctcccctctctagctccataactggggtcaaagccaggctaacttgagaagctgagtggaaatctcatttttggcttgctaagaagttgtcttgagacccctttgtttcatagggaggaaggtttcccagcagaggttaagttttgtgctcaggtttaaggcatgagtcaaggtcaagcttcggtagttgcccaggttttatttcaagggaagaaggagttcaaggtgatagctctctttgagggagggaggaagggaggactgtgtagttgtggatatggtagcctggccagccaatgcgtaagtgtaataagtaatcctcatactctcaccccatgctgcaagaactgtggtaataaccttgagcaacggcacacccttcctcctaacaacacaggtttaggctaaagacattatccattaaaaataaccacattttataaactttgtgttgtgtgagttttttccccattcttttttgaagcaactggcttggtacataaattacactgtgtgctagagaatatatgacacggctgtgaattacaaggtcataattttaccagcaattttagatgctgccataaaccatccaatgtctgagagagctctaatacattttgatttttttcctaagcccccagaatggcattctaggccagctcttaaaagatgcttcatttcttgcttttgttttaggaaaacaatagccaagtaacatcatccgctcctttctttcttttcttccctatagtatcgttgccttttatttttttgttaaattactagcatctatcttagatagatgttccctcagccttcttatgggaaagatgggcttatgtagggctttgagtgagcaaagttcccagagccacaccattttggcccagggcttgcctaaagacataacgaagtgaccttggaccaggtggttctgttcagtctcaggtggaaatgttttccctggtcttctgtccttaccttcttctccacttcaacttaagttacacctacatccttgcttttcccctaattttcaggcctttgttcatttgcaaacacttgccctcagtttgacctgcctattcccccctcctgtagctaacaaatttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtctgttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattcctccccctgctcacctttttctcttgtctggaatgctcttggccctccactccacttagttaaggcttttccatgttttaagactcaactcaagtccagctcccccagcaagtccctatggctacaggcacatctgcctacttttaacttatagcatatactacatgtggttcctaatcagaacataactcatcccatctgaatacaggcctaactaattggcgtgcactgagggagcaggggcagaccatagttctcactgctgagggggaatgtgactggttaaaagacctctaagtctagcccaggctatgctatttactacttgtgtgacactgcagacctcttggaacatccttgcccatatctgccaattcagagataacaataacatccatctcacagagtttatcaaatacagtaatgcttacaaaaggttttcacatagttgaacagctgtggaaatgtcatgtcttataaatgcacctaagtaaactcaggcaaccctaataggccctggttttgttagtcattgaggccactccttccatatgttatgttcccttggcactgagcttcctttcaaattaagaattgaattgattcatgcaggtgactcaacaactcataatttagatctgctttcactctcaccatgaaatacacacagacagctgacaccatgctcttgacttacgagcctatttttctaaaaggcccagtccctccaaggctctttcatccactcaatatggtcagccacaggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagcgatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattcagttatgagtgtgtttagagatgtgcatgtatcttgtagtcaacgcatggataacatgtgaattctatccaaagcaataagtgctctgcatacatttaaatgcatgtcttctcatgtttactcttctgtagtattatttaactatttattcatcttttgttatattgacttatgaaagactttgaactcttgttgtagaaaaggtatttggaattcccatatctataactagattaagctactctaggctgaaattgtgtcttacatttcacagtataccatgcacaacaagcagagtgctatgatccatatgtatctattgagtgaatcatttattaatctcaaattacatccccaaatcctgttctttccttcctttgcctttttttcctagatatcaagaagcacactgattctagttaagtagttattactttgagctcagttaaagatactaaatattggcactcttggtggcccccattccaagcatccttttatgtaaaagaactgtaatcctatgagcaaagacctgtaaaactgactgcagctaagggaattatgcccccatgcagataatgctgtggaccaaacagttccgataagcaaacaaaatctctcagacaattatgttcttgtttaaggccgtttgccttggaattcccaaaaggattctggaggattgcaaatttgctggggatgaagaaagaaagtactagctagagtttaatagattattggattaagacaggccagaaacagtcaaacaagaaaagtattatgcaaaaccttctaaggttctaatctcaccttatttctattttgattaatattttcctgggaaagaaaagatgggggtttttgttgttctctgactacaatccagagataacatctttgcctccagttttcatcaagataaagacctggaagacccgagccaaaaggaaggagctggaattttttttaaatctttctttctggtctttaaggaagttatctgaaaacccactggtactctccaatgggtaaagaatgagacagaactagcagaaagtgttaaagcattagacaggcaaattaacttagagacagtgggagaatgattccatctccattgattttccagtctgtaaatatgaaatgctggaaggatacttgtgacatttggaaagttttatctagaaatctccaattaattttagagtgcatagcatacatcaattaaacagactgcggggttcatatttcctacacggtcgtgactcatcctcggaagatctgacccatcaaggataatgatttcatcttgatattggtgactaatatttctgtttgtatgtccagtgtctgctacagagcctgacatagagtaagtaaatgctcaaacatatggataaatgaatcaattaaaaacctcataaaatctttaccctattaatcttcctcctatagcaggggttggtaaactacagcctgtgagacaaatctggccaccaccagttcttgcacaggacaccagctaaaaatgttttccccctacattttaaaacagctaaaaaaattagaatattttatggaatatgaaaattgtatgaaattcaaatttcagtgtcccgaatacaattttattgggacacagctatgtccactcttttacctattgcctatggctgctttcatgccacagaggcagagttgaatggtggtggtggagatcatacagcccctgaagccaaaaacattgactatcaggccctttatggaagaattttgctgacccttattctatagaatggaacttgggaacccttatcatttgtcattcattccattgttcactcagtggctatttactgagtatctcccatgcgtgcagtgctctgtcccattctggggataaaacagagagctgagaaagatccctgccttgatggaactcacagtctgggtctggagcagcagaaagaggctcatcaagtaaccttccaagcacctttgcaatcacaacagtgaggagagctaagaaatggtacatggggtaagcttccatgatgtactgatggttatgctaattactaaagactgtcaaatcaggacccaaattgtctagtgccaaggtggatgtctttgctccttcctttttctgccctgagacactcttcattctcagttgggtttcccttttagaatgacctgtgacatgtgtcttctcctcatgtgacactcttcctctttctaaccccagcacctagaacaaagcctgacacacgggagacactcagggcatcactgttgaacaaatgaaagaattaattcattaggagaagaaatgtaagcaaattcctgggcatccccaggccccagttttctcatcagtagaataagaaggatatgatgtactcaagcctcccagctcggcattctgcaatttgtcatgtcctgagagctggactcatctggctttctgattcactcctctctgtggacataaggcagactccctctgactcagcagcctgatgcatcttcctgagtgacacatgaactctgcccaaggcaaggcggccagccccaatccattccacggatcactgctgacagtgaatgggagtatacctgggggttttagccaaggtctgctcaaggtctttggcataaagggaggccaggttgaacacacaccagcaggaagagagatgaccttgacttcataaattggccataaattagagctaagaatcaggaagattctccttccatgcacatttctaaatggcagtttcaaggcaggtggctattttaaaacacagacacaaactcataattcaccctctttgtcccccaccctcctacatgccattgatctttcttttttttttttggaatcctgaaacatgatctttaagaaaagacaactggactccaggattacttcctagctcttcctcctctagaagccaccatttctcttcgctatctagaccccagggaagtggctttggcaaaagcacatttgcacccatggatcatttggttttcttgtcctgttaactgcctggttctgcagcacccagagccagataatagaggtgttccttcaccagccacagctactatcaggatccctcttagtccggaggtaacagaagcaactggttgaacgtgtttcctcctgggaaatcctaaatgttccatatggcaatagggaatctagagttgtgtttctccttgtattagggatattttccctctttcagtttcttcccattttttcccatctaaaatatgttttttccactttgctgagatgaagaccagccagagagtcaaaggaaatgacagacatgccataatagaaagaaaaaaatacagacttctgaagaatgagttgattcatgccatgaaaactcacgataaaaatattcactacttttttttggccacttgtcatagtgtgctgcctctgctaggcagctgaaagtgtctcatatgaaaagctctattatcctccacagaaatgacctttgggacccacccaacggtagtcaatggtaatattatactaacttgccccccaagaggaaagaatgaaataataatacttaaaatatgaatgcagagaagtcctcacttaaacacagtacttctggttcataaatcagttctgacacattgaagtacacatatgatgactagacgcaagtttattaacacattttctttctttttaggtctgagaaacatatctattcagaatccatacatttgttcattttttgaagctgacagcttgataggcaaaaagtaaagtgacagatcatttcaatatttcttttaaattcaaaaccaattcagtcaaaagaccgaaggaaaatattctacggagataaaatgataatgcaaacaattgaagacagtcctttattttagtgaaaacaggtaatgtctgtactctggagtcgggctgacttcctcctcttaacctgccctgcaagtccaattagaatggttttctgcggggagttgttttccatttatacttagcccgaacacgtatacctacttttcaaactcttagctattcacttgacatttgtcttcttcagtcttcactaaatagtctttggaccctttgggagtcttataagagttattttctgaaagttaaaaacgtaggaccttatttcggcagaggttaactaaaccaggcttcaaagaggattctgagggcgacagccactataatgtccattcctactttccttcactaggtggcagcacgtcacaacacatttttcagaacagtctggggaaaatgcagttgagctaaagtgaggttggggagtctctgcgggctatgggaggaggatacacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttctgacccagtttgtaaattcgagttatagtattttacgtttgctaaaatattcacctaccacagtaagaatttttgtttatctgatgcaacctgtttggtgttataggcagatgctaagttacaggctttgtggtggatactgggcaacagatgtggtaagaaggggagcagcccaagatgaaatttcctccaaaacaccagaggttcctgtctcaagcagagaaatcataatactgcaacacatactagtttgcaaagggcaagtcgctatggccaaaaatgattgattcagaggaagaggaagggaaggaagaagaaagagaggaagaggaggggaaggacatggaggagggaaaagaaaaggagaaggagggagagggagaggagaaggaggaagaggatgaagaggaagaagaaaagaaggaggggaggaggagttttaactgaatactgtatttttgccttaatgtaggaaagatgaaggggagaaggaggtaactgctagtggacattgagaagctgtcaatacagcaagaccttgccaaaggttgatcaatagcctctttttaaaattaatacatagtagatggatgtattttcagtgtctatgtgataatttgatacatccatattgtcaaactagggtaactgggacatccatcaccttaaaatatttatcttttctacatgctaggaacattgaaattattcttttgtagctattttgaaatgtacaattgattcatgttaacttgtcaccctaatgttaactggtcaccctactgatctatcaaacaccaagtcttatttcttctatctaagtgtatatttattcccattaatcaacctctcttcatcctcccctccttcctacccttccctgcctcagataactaccaatctactctctatcttcatgagatccccttttttttagctcccacatgtgaatgagaacacgcaatatttgtctttctgtgcttggattatttcacttaacacaacgacctccagttccatccacggtgccacaaatgacagggtttcattctttttcatggaacagccttcctttgaagagagacattcactctcctgctagagacagcctccacctggcctgcttcacccatttgttatcttcttgtccctgtaagcatttgtgtttgcaatctggggtttatagattcatctttcctatagtagggctaaaatatcttagtttaaactccaagcctaggacaacagctggcacattacacttgttttaaggtttgttgagtgaatgatgataataataaagatgatgataataatgaaaccggcaatatttatgaagtttcttaaccagggcagagactagggtaagacagtgatgcatccagggaacaaaattgaaaggcacgctcattttctttttctttctttcttttttttttttaattttgagacaggggctgactctgtccccaggctggagtgcaatggcatgatcttgtctcactgcagcctcgacttcctcgagcaatccttccacctcagcccccaaatagcaggaacttcaaacatgcagcatcatgtctggctaatttttgtattttttgtagagatggggtctcaccatgttgcccaggctggtctcaaactccaggactcaagcgatcctcccacctcagcttcccaaattgctgggattacaggcatgagctgctgcacccagctgaggccctcgctttcagggtcacttgcttcatcttgctcctagcctatttataacataggccagttttctttacatgatttatctcattggtagggcttttaaacatttctgtctctcatcacatgtatgagttactactaaaccgtgggtatatagtagtaattaaaagctcaggcgctgagatcacaaagatgtgagttcgaattcttgctgtatcacttgctgaagtcatacagcaagtaagacaggtcacacaggtcacctctccaagttccaagttcctctacctgtgtgttaggattaaatgagataggccggtaaagagctttgtccaatacctgccacaaaatatagtcatgcattgcttaatgacagggatgtgtcattaggcaattttgtcattgagcaaacatcataaagtacacttagacaaacctagattgtatagcctcctacacacctaggctatatggtatagcctattgctcctaagctacaaatttgtacagcattactgtactgaatactgcaagcaactgtaacacaatggtaagttttgtgcatctaaacatataaaagatacagtaaaaatacatattataagcttatgggaccaccattgcatatgggaattgttgctgacagaaacattatgtagcaggactgtacatagcagctataataataataacaataacaagagcaaaaataacttattttattcctattacatttataaggatttcagagaaaaattcatgttcaggtcatcaaaattgattagtagctattgtatgcaaaacatagtgccagacatttagaggaatataaaagaatatataacatagctgcaaatctagaccagggatcagcaaactttctctaaaaagaaagataataattttttaaggcttttttgggtcctatcttcttcatgtcattgccataaacaatatgtgaacgaatgaacatggctatgttccaagaaaactttatttacaaaaacaggcagtaggccagagtggctaactcctgatctagttgatgagtcaggacaggtacatgttacttataaaaacacaaccacatcagaagatcacccatgatcaaaagagtggctcagactatagtggttttggaagaggcaagtaacaggataataactggttgagtgcaggtaagcagagaagacaagaaagcagctgctagacaagaaactaccaaaaccatggcgatggaacatatctgagattgggtaggagtggttggtaagtaggctggctagagtgaaaatgggagaaattcacaaaaatgcaaacagggctggagaagaaggctaggtgagaatataaagaaggaagaccatgagactgagttttttgtttgtttaatttaatttaattttttatttttattttttttttaagatgggatttcactgtattgcccaggctggagtacagtagcacaaccacagctcactgtagcttcaacctccaaggctcaagcaatcctcccacctcagcctcctgagtagctgggaccacaggtatgtgccaccatgccgggctaattttttaaaaaaatttttgtagagacagggtctcactgtgttgcctaggctggcctcaaacgatcctcttgccttgggctctcaaagtgctgggattacaggagtgagccaccacactcagccaagtttttacaaaaaggaagtatctgctgtgctcccaatctggccagtgaggtttgcaatccactcaggaaataataagctaattttaccctttatgagctgggttgctaaattcctacctggccttaaaggggtaagtcgaatttagtgattgtgatatgggagcaaagtgtcaccacactagtgtttggcatttatttcgagtgatatagtgtgtcttatgaaaaatgggccaggcacagtggctcacacctgtatcccagtactttgggagaccgaggtgggcagatcacttgaggtcaggtgttcaagaccagcctgtccaacatggtgaaaccccatctctactaaaaatacaaaaattagctgggcgtggtggtgggcacctgtaatcccagctacttgggaggctgaggcaggagaatcacttgaacccaggaggcggaggttgcagtgagccaagattgtgccactgcactccagcctgggcaacaatgcaagacccaatctaaaaaataataataaaaataaatttaaaaaaaagaaaaatggagctctgctcaccacctatcatctgttcttactctcatgagcaggcttgggcccaggcctgggcatctcagtgtctgcaagtgagatgactgggaaagaagatttgttcaaataagtcaccctgctattggagagaggctggaccctaagagagcccttccctcgaggagcgggctgagatactgtatccctgggagaaggttggaggtgaggctccatccctgggagaaggtcggaggtgaggctccatccctgggagaaggtcagaggtgaggctccatccctgggagaaggtcagaggtgaggctccatccctgggagaaggtcagaggtgaggctccatccctgggagaacatcggaggtgagactctagggatgagttagaaatttggcctgggacctccctccgcccctctccttccctaatctccaacacaccctgtatctattttcctgaatgagttgaccctatcctaatttcagagagtttaggaagcgatatcaaccaaattggctctagacaaaatactagtgactaataaagtcaagcaaaggtgctcattcttactagtaaccaaggacttggaataccttagaaggggattacaagtggaagatccaagagctatgggaaaagggttctgctgttcaagttgaaattgtaatatggaatatcataggatgagtatatctcaagatgtaaatgactcagattttaatctcaaaaacatatgaaataaaggattacattaataagaatactgatatttaggagcacaaaatagcaaggtttactctaataccagaatcctggaaacttgcatagcagctacaactagaattcaagttcagcctcaccgtgggctggaccagcagatctcaaagtgtggcccccagatcagcagcagcagcatcacttgggaatgtgttagccatgcagatcctcaggccccatcccaggtgtactgaatctgaaactctggggatggaacaccccaaatctgtaatttaaccagacctctaggtgactctggtgcactcaaagtttgagaaccactggtctatctagaatacatagtgtgcttgttccaaagcaattgtccttaccacgacccaaagagcctcacagaatagatttcggaaagtacgtgtgcgtgtgtgtgtgtgcgtgtgtgtgtgtgtgtgtgtgtgtgtgtgtgtgtgtgtgtgttgaagtttctcaggtattcaggtatgttcctctggtttaagaaccaccactgtgccaggcctctcaacagtggctgcacaagtgaaattattcagagaacttgaaaacattctggtgactgagttcatccccaattctcatatgcttggttagaaatacagtctggccaggaggacgtgtcagagttcctgggtgattctaacatactgccaagatcatttagcccatagaagaatcaccaggagaatttgttaaaacagattcctcagccctacctttcagagattctccaggtttagggttgaactccaacatttttatttctattaagctcccaggccatgtgctggcttgcagaccgcacctcgagtagtcctgctctaggagaaacatgtttatattttagatacctgaaatcttctttgggctgggatggccaactttcctccatctgttcctcctctaaattcctataaacttactgttctttctagaggacactccaattaagttattaacatcttatagaggcaagatctatgttttccccatctttgggtcactcctagcacctagggatttgcacacagtaggtgttcagctgaataatgcagtcgaatccctgagctggtttcaggtgttcattttctccctatctgatctgctagccaggtcaatccattatggccctggtctcatggaaaagaatcaaggcatctattttttgaagatgatgtgaaggtaaatatacgtccagtcctagagatttaggttgctgaggaggctgttccaataataccccagatgaagtacagccatctggagaggttttggcatccatgcaaacctactgctgaattcgttccttgaagacattcattttaggatggtatttccaatttggcatataacagagccatgcaaatcaatgaggatttagaatctctacttacggagggcatcttatttaaagcgtgtccctgacaaagcaatatcaagggaacacaattggaaatctcttggagaggagtaatttctctagaagcagttttagctatagcagcgaccggaacagcaatgagctccctgaaatacatccaaatttttagtattccacttggctgggctgccttcttcagagcccaatcatagggacagaacttaataatgagttcatttttcttgtcacactagagcaattcagttgcaatgctattcataaggtgtatgttgccattgaattctttctcaaaaaaaaacaaaaaaaaaaaagctcaagccaagagtagagccccatgtcagtctatatgcgctaacaaaataccttagactgggtaatttataaacaacagcaattgattgctcacagttctaaaggccggaatgtcccagatcaaggcgacaacagattcagcatctggggagggttttttctctgctccatagatggcactttcttgtttccctgcatggtgggagggacaaacagcctcccaagggcttctttcataagggcaccaataccattcctgagggctccaccctcatgatctaatcatctcccagaggccccatctccaacacgacggcattgggatttcatttcaacacatacatttggggcagatacaaacattcagaccatagcagcccataacatctagcatgatactatttcaacatggactaatggtaaaaacatggattgtttttatttatttggctacttgtatagaatgggtcaagaagctcagaagaggggactggtgaacatgggggaaaaaagtagtttggaggctggtaagttattaaaaatgtgttaacttgtagcttgagagacagcatagtatcatatcaagtaacatggactttggaggtagattgcctgagatcaaagctgagctctaccatttactcactaggtgactctcagcaatttatttaaccttctgaagcctcagtttccccatctgtaatatgggcccccaaatgacacctatttcatagtactgtttggaagagcacttgagacaattatatactgtatgtacatacacatacatacatatatatacacatatatgtaatatgtgtaatatgaacacatctaactttattctagttatggaagcacttttcttttggatttctctttctctcaaaccccccaacccccactctcctaaggacacctggcccaaaaagggaaatcatactttttcttttctttatttcactattcttattctaaagaaacccacagactacagacagcagtttacttagaaggctctgggcttcagggaatctagatgtccaagttgaaagtcagctgcctggaacatggagtgggtgacctctgggggcactcaggggcccttccttccaggcttcgggcactgtcactgagaagcaactcccttgggggaggggtgcttttggtcatagcggttgagtcaagttatcagatgtcaaatagcttataggagttcaaagtgagcctatctccaccactgctaaccacgaactgcccatctgagcatgatgaaattggcccccttcccctctccccttgctacttaattgctcacaaatccagcaaattgcaggaccagcctctagggggcaccagagacctttcctttcagagcccaaaatgccatttcagtagcagcagagtagtgtgtcctggagctggagcatggtccagtgtctcttgtgctttttggcctactgagtccttaagtatatttaatttaatttgggtagggtggtagagggttccttttaacagtgtattcatgatttctctagcatttcttcaggaaagttatttatttcttttagatatagaatttttaccattggtccattcactcaaaatcacttcaaaaaacatttgctaagcttccactatgtgcaagagtgtcctgggcatacaaaaagtaaaaagccatggtgtgtgctgtcacagactcattctagagcagcgtggtcccacagaactgtctatgatgatggaatgttccacatctgtgctgtccagctccgcagccaatgagccacatggggctcttgagtacctgaaaaacagctggtaggatggaggaactgagcttttaaataggcaaatgtggctaggagctaccatactggacagcacagtgtattagtttggtgcaaaagtaattgtggttttggccatttttaagtggattggtaagcctggctatttaaagtgtggtccacagagcaggagaatcactacacctgagagctggtggaaatgtagatctctgacgttagcataggcttcctaaatcagaaactgcattctaacaagatctcctggtgcttctcatgcacagtaaagtttagaaagttaggagatgcatacaagtggttctcatcctgactgcacttcagacacaactgagaaacattaaaagaagctgagcctaggtcacaccctccacccagagattcttaggttaatggtttaaaggcttggcctgaacatgaagagttttaaaagcactctgggggattctaataaaaattcgagaaccatcccagcataagtcagtacggtggctccaaaactggagatcaccaggagtgcttgttaaaacacagactgctggctccaactcgcggtttctgatccctgggtctcggttgagctctaagaaccctcatgtgtaacaagtccccagtaacgctgatgctgctgatccaggaaccacactttgagaaccactggtctaatcattttaaaagatgggctccagaattggactaacctgagtcttggacctgccacttacttagaccctgaacctcagtttcccaaactgtaaacttgggctatgaatatttactcatcgagttattgtgaatattaactcagagaatgactgtgagatgctgggcatagtgcctacttttaataagcaatcaataactgttccttactatcatgatcctaagaagactcactcattcattcattcaacaagtatgaactatgtgtcaggcactgttccaggtactagggacatagcgaaaaacaagggggccacagtccctgccacattgctatcatggaagctgcagtcctacctgtcagtacaaagcaggctgcgtatggtgctcctatagcacgaatcctaacagcacaatacaaaggtcagagaggaattcattccaatggatgagaatgggaaagctgcacacaggagctggagtcagagctgtgccttaatggggagaaggattacaacctgcagagtcagggcaggaacttactcatgaccaggcacagggcagagacagcaagaagatgcagctagcagcctagtggagctggggcaggaagtacagggaaaggggaggcaggaggcagggctgtgcatatggggatgccaaccagggtctgcctccactctctggccaaaccatactatttgtgtttgtttaaatcccaaacactgaaaattactgatgtcaggaaactgaaaccaggccacagctttcattcttgattattcttaccaaatgcagaggccagtcaacagaaggtccagagattcacagaatcatcctgaccctgcctgaaggtggggcggggctcttcagccaagcaggtggccttgggcccagatgctccattgaagcagaggaacagagagatgcttgagacttcagctgagccctgggtggggtaaccattaaaaggaagagtggtgtgctgaccccatccaccgcttcccttaggaaaatggtggcctaccaccacaactctttggtctcatttgggtttctctgtaaactccagaaagcaataaagcatgattcctaaaaaagagggctactaggtggaggttatgcagacctaatatgttcccctcagtcactgcagctgcacaggaaggggcacccaaacctcagagtaagttgcgtaagaacaacagacaacaggcaagtctgtctagtaactcacctgttcccatgaaaagaaaaaaaaatgtcactccatgcaaatgaggggtgtgggagggtgttgagcttcaataaggctctccccaacggtctcctccctaacaggctgtaaaataacatgaagcatggccccaaagggccgtgaatgacccctggagcaaaggactccaaaaggctctgcagagcttttggcacatctgaacaggggcccggatcccagcgcaccctcttctgggctctgactttggcaagttactcaacccctcagagcctcagattcctctttggaaataataatgggaataataatatgccccttttggtaggcagaacgatgaccctcaaagatgtctgtgttaatcttgggacctgtgaatatggtcatctacatgccagaaggaaatgaacgcagcaggcaaattaaggttgctgataggctgacctggagatgggaagagtatcctggagtatccaggtgggcccaatgtaatcacaagagtccttaaaagtagaagaaggaggcaaagaagagatggcaggaagcaagatcagagtgatgcaaggtggggatgcacccttagttgctggctgtgaaggtggagaaaggggccatgagccaaggggtgtaggtggcctctagaagctggaaaaggcaaggacatggaatcttccctagagcctctggagagacccatgttggacttctcacccacagaactgcttggaaatagaaaacttctacaccattttgcaaggttgtgaggctgatgcttggcactcagcaaggcctctctctttcttccttccttcctttcttccttccttctttcctttcttccttccttctttccttccttctttcttttctttccttccttttattttccttccttcctttcttccttcctttccttccttgcttcctttcttccttccttcactttcttccttctttccttccttccttctttcctctttccttccttccttctttccttttcttttccttcctctttctctgtttctctttctctctttctgactttctttcttttcttttcttttcttttttcttttctttagcagggtcttactatgttgcccaggttggtctcaaacacctgagctcaggggtcctcctgcctcatcctccccagtagcaaggccactttcttctctaggctgttattagcttctgtgggtacacaccatgctccacacatactaggcttcattctccctgtcttagcccatcattgcagcctccactgagccccagcctctcacagaagcctatcctcattctcccacccacatgagctctcactcctctgaactcccatggcctttacagcctgtaccttgcaattacgggcttaattatatagtgggtagtgttacctgctgtcactgcatgtgtgtttattttggttccaaaatgagattgaaactttagtctcaaacaggaacaatgttttgtccttttgttgttgttgtttttaagcacctgtgctttttttatataatcctgtttttattgccttctgacacaaaaaaaggactattttgggcatatatttataagcagataccctacatcattgcaactgccctgtgattgggcattaactcatttttctattttctagcagagtttactgaaggttttaaggtttaaggtctaaggccagttctgatacagacaatagaatcaagtttatagttttccaatcatggttccaatgaccatggtcccttatcatatgccgatttcatcagtcaaagaacaggggatggtgttggaaatcacagtaccagtaggatacagggtggcccggcatgtgttcctctcatcccagtgctgagcacacagtaggtaataaaaatgggctagaaaactggctggtgagtgcatcattactttcctcctactcccttctttaaatcctacaagatcaccctcaacaaaaacatacacacaggcaaggtgcagtggctcacacttgtaatcccagcactttgggaggctgaggcgggtagatcacctgaggtcaggagtttgagaccagcctggccaacatggcgatcccgtctctactaaaaatacaaacattagctgggtgtggtggcaagtgcctgtaatctgagctatcggggaggctgaggcaggagaatcgcttgaacccaggaggcagaggttgcagcgagccaatatcgcaccactgcactccagcctgggcaacaagggcgaaactccaaaacacaaaaacaaaaacaaaaaaacatacacacaaacagaggcagcacagcccattgacctaccttggggatacattcccaaaagagaatgagacagacggacatatgagttctccttggagcatgttattcaaatctcaaaataagataaagctctcatttcaaggtgcatttattttagtgaggtttggatttgtaagggaaacaaaatgaataagttggtgggtggggacaggaattaaaataagcagcgtcttgctgcttgccgacatgactgtcctcacatccgctgccttattttttattctgttctggtttgttttctcctgcggtgctttaaaatatgatgggtaggttagaaagagagaccgaggtaatcctggcttctgttcattaagctcgtatgaagtacgtgctgtgctactcacattacctcggtgaatccctatgaggtgggtgctgtaattagcccattgtacaggtgagataactgagcctgaggcagataaaatgctcatgctgagcgacccatcagcaaacagtttagccaagatgtggactgagttggtggagctcagagctgagctttaatctactctgcgccaatatccggggtgttcttaagccccagtctctctgtcccagatggagcaggtcggatctccaagctgctgaggggcactaggactcgggagacaccaggctagctctgcattcttctggtcctcctggcatttctagaaactggaggtgggcaaggaggagggggaaagaggagccaggagaacacggagtcttaaataagatctcttccctctcttcctgcctggagtgaagccctttatgagtaagcaccgatggagggatgccaacacaacacagcaaaactagccctgtcattcccaacccaggcctcacaactccaaatcattcaaggggtaaggacacagaaagaagagcagaggaagagtgtggacataaagtcagaccacatactggggaatgcacccctcccaccactcccaggagatgtgaccttggacaagataatctctcttagcctcagtttcttcatctgtaaatggggaaatgacaagtcctgcctcataggtttgctctgaggattaagtgagtccgtgtctgtgaggggctttccagagtgcccatcacacagtaggagctgactacatagtagtgtctctatgagtacaccgttacatgcactaggatgatctgcacaatgaatatattctgtactatacaacacgcaatcatatgccgacaattgaaaactaaacacggtgtggggagcgttctgggacaggtaagggcagggaccctgcattcactctggtttttatctcccacagagccagctaccgcacagtcctgtaccctcagcagggccaggaaagtttgtgcaggagaatggggatagacttcggtttcctgcatcttatcccaaacctcagccagaaaaggcagcacccttccactttccaggagaagggcagccatgcctgaaatgcccctatttaatgggattatttcttctcctttataagtcatatctcatgggaatgttcattttctctctggaagctcattggtacaatggttgtttcacaatgtaataacccatgtattaagtcagatgagaacctccttgaaatattattgtactgaattctcttccataacagggagatcagttttagatttcacccaaggagatttcgctaccaaagaacctaaagcatttcattaaaggtgctttctcctacaagaggaaagaggtttttttatttttgttattattatttcatatcccaaaaggttattgttctatgtgttcaatttcaatagtacttatgcttcctaaccataccgtatcatttacttccttattaggttcagtgtttcctgctttcccaacactgcagtataggagggtagggggataggactctatttcttcactgttgtttcccaatcatctggaatggtacctgacatatagtagatgctcaataaatattaatatacaaatggaagcacatttagagcacatttcttttggaaagcgaccacagttgatacaaagatgtatctcattagaaattcatttccacctcttttatttcctattcaatttttttcacccccattctgtgtttgtgccaatagattttttatgagatcacaacatatctccaaaaatcagaattaaatcatccacaggaaggctatggatttcaaagcataccagaactcctggccctaaaatgcttcagggaacgtgtcactcaccacaaggaagctgggctccacacttttaccgggggcatgttctgctcactgcagaggaggatgtctccaccacagtcaccagggagcccttccatcacccaggcccacaggggaccaagagacaatggacactggcagaaagtgcagattcatgaagtgtgaggactagaaggtaatttcatttaaacccccattcttcagatgagaaaactgaggatccagaaaagcaaagtggttgttcgagtgcacagggtaattaagcacagctcagtgaagaaggcagatcccacctctccccttccccatcgatttccctgtgtgtgcatgggtatgtgtttgaactcttagcaacaagatgttttaaaaggagtccctgttaacaactcatccataattttgactcaggggtgctgctgatagaattctactagcttccctgtccaccccaatgacctagatcccaaatttcccattaatgacccaagaaccttaaagactttctgagctaaaagattcttcgaagtcatctagccaaatctttatcttacagatgaaaaacaacaggctaggtaaagaaaattgagctcccaggtcacaaagccagttagcagtgaagctacagcagctgggactgctggcacccagggccacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcaggtccaaaacaaaaacttttccttagagcaagagaatataattctaatgagaaaactgtagcaaaagaaatctttttaggatatggacacatacatatatatatatatgcatgcacacgtgtatgtgcatataatatagagattaccacacatactatattaagaagatgcttattttttaaaaaaatacttgacactaggtatataataaattcccagtgctagcaatggcatcaaaatggattgctagcggaagcctatcttgacacaacattttttaagttatccatcaatgtctgcacaaaagaaaatacacatattctttgaaccagcagttcctcttccaggaacctggaactattgatagaattagaattatacaaatatatgaataacagtgtttattaaaccattgtttctagcagcaataaaaggaaaaggaaaacattcaggtggtctatcattagggttatggctgaatatactgcgatacaaacaaattatggaattttatgcaactcttacaaaatgagttatcacagagctgacggaatgtccatcatgattagttaggaagccaaattgtggtgcaatgtaattatttgaaacaatttcttatacaaacaccaccatctctaaaacactatcatgtgtgcacatgtgaaggcctgggaaccgtgggtgtctaaaggaggaggcagtgatggaggcaaggggaaaagatgatgaatgctctcttcacacatctttgttttcattgattacaatgcatgcatattactttttaaataattaagccaaaaatcctaaaaataaggacagaaggaacccacaaatagtcctccaggttctgtttcggcctgccttcttccctagtagaccccatgacagcaggaatactctgaattcagggaaaaaatgaaatcaacgcagcaatgagaaacttgaagctgtctctctaagccctgggcttccatgactatcctctggtcaagttactttctccactaaagtgttctagtcctggtccaggaggtgccctgtacagtacagcccagcagcactctccccttaacacagaaagggacctcagtctcctgtaaggtgagagatgactcaagaagcttcatctctccctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaatgaaaagtgacagaaccatgaacataaaggccctggctgtgacagtgatgaccactaggctttgacaatgataaaactgcactgcctgaagcgcaaactgtgcaaaccctttggggctagtgctccaaagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaacttctgtttaagtacacagacacaaacacggggggcaccgtgaagaaatccactacagagttcacttccagccagaaccacaatttatcgttggctgcaataaactgggggaaagaagaaataagaaagagaaaaaacatgagaagcatggtgctggcatccaatgtacactcttttgtcaaagggtaagttttgagttttcatagggccaccacgcccggctaatttttgtatttttagtaaagatgggatttcaccatgttggccaggctggtctcgagctcctgacatcaggtgatccactcgcctcagcctcccaaagtgctgggattacaggcatgagtcactgcactcggcctatttctatttaatttttaaggtctggagggagacattatgtccttctcatatctacacaaagcacatgcttttatgattggacacacacgttttctagtgccccatagagagccctatatagactaactatatgctatgctagtcttaagagaaagatcaggcagtgtatttttctgtggttcccaacagcttcatagggaagattgggtgattttacttgtattagactcattcatgtaaatataactataaataaagcacatatgtacgcattcacacacacacacacacacacacacacaaaattccatccatctactctcctcaccttcctttcattcatactcacaactgctctctcagggctcagctaagtgaacactgctaaacgtaattttaagagctgaagaggtttatttctatttacttttgttttgttttatttttttgagatggagtcttactctgttgcccaggctggagtgcagtggcgtgatttcagctcactgcaacctctgcctcccaggttcaagcaattctcctgtctcagcctcctgagtagctgggattacagatgcccgccgccacgcctggctaacttttgtatttttagtagagatgggatttcaccaggttggtcaggctggtctcgaactcctgacctcaggtgattcacccgcctcagcctcccaaagctgggattacaggcgtgagccaccacactcagcctatttctatttaatttttaagggaacagggcattatgtgaatagagagatgagaaacaatccaccggtggatacatcatcatttttcttcaatccctatttctcccccttgaaacaaaactgatgtgaattccagaaaatgcttagctaaggagagggctctctctcagactgaaaatcagaatgcgggtgcgctgtttctcctggaaatatcttgactgcgagagcagaggctgagggggatgatccctgggtcccagactgaaacaccccattgtgatactgaacaatgttgcacaaacttacccgcaagccgaagtagagaaggaagaacacgttgaaagccatgtcgatctgtaatgtgaaatctttgtagaaattctggcaggattctattgggctattagacaggaagaagaaaaagcaagaggtaaatgacaggtagtatcatcctgtctcccacgatgctgagaagtggtagtgcttagggtagacgatgaaatgaatattcataaaagaaaacatttggtctttctgcctcctgggatcatcaagcaagcattgccaaggggtctttccattcaaccattcaggaactactgttcttttatttattgttttcgaaattattatatactatcattttttatcatcattcagcagttgaactaagaatctaaagaggatcatgcagataccctggaggaaggacaagcaggagaggcctccaaattccttaatttcatattaacccttaaagaacttctttctttctttgagaggacacatactaaagctaaaacacagttcctcatgccctccaacgcattggcagtggggcctgttttcaattaaacacagtggttgtgttttggaccttttaaaaaccattagttgattaataaattcaggacccaggagcatctcaagaaagctagagaggagaggatcctgggtgaggttctggctagattaagcacagactttctgtgcaggactcggatctggggaaagaagcattgtccgaccagtcaaattcagaccattaaaccaaaaggttgaagcagtactctaagggttaattttttttttttttggcatgcatgctaattgacttggtgtgtgtgtcgagcagccaatgcaaacccctagcacactctacttcaagagtcgccagttcaaaagggtactactatacaaactggtacaagacttctgtgtgctttcctgtgtcaaactgatcagaggatcagtgtgtggaaagtcccaaggtttgggctgggtgggaagtaggaaagcctcataaacactcaaagctgtgaatggaaattcacatagtattctgtgatcagtaggtaaatagtaacacccaggccaggaacgtgaaggtgaagtgaggtgagggaaaggagacagaataccaagagaagcaaaacactttagctaaagggaagcgacagacctcctccctccaggagagggccagcttgagaaatggaagatgaaggatttcctagtagtgccactttggaaatcactgtgtgcaataccagttagtatagttgcacttctgtaaggacaacgcttggctgttcaacaggcaggaatctgtgcagtagaggaactcggggcccacttagaggcagggtaagttagtctgtgggaatctccgatcatgttccatgcactggatttatccattcttcatctctgctacaagtcaaacatgccctatatcatctcccaaatcacgtggaaaaatctccagacaagcattaagagtaacctttatttgcattcacaaactaggtggactgaacaaaaaacaacactgaaaaacagttcaaaaaaaaacaaaaaacaaaaaaaaacgacaattgccaggttttcactaaggtagggaattgggtagaaagacagcatggaatttggttagtccaatgctgaaaggagacacaagcaaggaagccaaatatcacagcctgccatggctctaggcctgctctcctacacaggtactaatttcgatgaaaaaaggaaaatccaggctacagtgaatcggtgatacttctgcaattctcaggccatgggggtgcttgtttttgtttcaaaaacaagacccaaaggtccatgggtgtcagagttcccagccactctagttgcagtgaaaaatgtacaggaactaggttgaccagaaatcctatagactccagggttgaagagacaatgcatctctgcaggatacgttactaaagagtaaatgtgtgtgtgtgtgtgtgtgtgtgtgtgtgtgtgtgtgtgtcagagaataagcaagcaaggatggggagatctgtaggtaactactgtactcaggtgctcacttgtgccagcggggactcacatagctgtgcattataaactcacagtcatcaagattgatgtatacgcagtcaaggggagagaaaaaaagggcttggtttccaagactatcatggaaaactgactattgtttcaccaaggccaaaaccttacagttgccctcacagtcgttattggtggagttactggtggcatatttggggccatcatgagttccctagctcctattaatcccgtggcctctgtggttaatttggtggtaacctagaaatacagctaattggaaaagtatttgctaggctgtggtagaaaatggaatagttgggggagagatgtgagctgaatgccacagaggatacttggattcaacataaatggaaacaggtattgagaagagcataaggaattggctgcagtgacttctccactgtttcttaccttcctggtcctttctgtcatccctcctcataatgcttatgttcaatggccacagtgagagggcttgaagctagaggacatgggtgttgaaaaacgcaccttaacaacacccctggtttacaggaaaccatgttgaagccatacaagaccttttccttttctctaatcctttcaaaaaatttagaaccgatttcatcatgtttcattatcattccttgcgtactagacttggagctgaaatactaaaggaagtaaatgatgccgctggcgcgggtggcttttcctctggctggagctggcaggtaatatgagcatacctcaataatatgagggggcagggggcaggcagagaagcaggaaactctgggacaaaagacccatataggatgagtgatcgggcaatgtactttctatcccttttagctatttcctgcttgccactacagccccaggagaaatgtcctgcctgatttttttcaagtggcaacagaactgtttatcagatcccctctgagataagtcctctgagtgcctgtagtttacggactcgcacaatcagagaccacagagtggagcttccaaatccccattatttcattccccaaatggaaacaacccatggagaagttcaatgatcctttaaaaaaagaatacatatttcaacaacaaaagagttggccatatcaaccaggatttattttcctcccaaagagacttcatcttaatgattaatgcacattataggatggagaatgaaatacaaacacctctcccttcttgtgtaaagtaggaggagtttccttgtctagatacacagaaacttcaaaagctagcaaagaaattgtgctttaaagaaaaaaaaactacaaaggaaagtgactctggatcacacacagacttagatttccagtctgatgaggcatatccacctcagaaggatttacatgggcatatgttgccaacaggaaaaaaaaaaaagtggagttttatgaactgaaataacactagttctgcctctggtagtagaaaactgacttaccctaaattgctacgggttaactaacttaacttatatcctcttaataattagagaatataagatacttggtaagtggcagactattcatttctaggctcccataatccatgaaacaagtgtgatactaaaaccacaggcaaatttagcatgttgaccaggactccatgactgagcaccttcaaaagagcctcagtaaagagttgattcttatggagtaaatgttcagttgtagggtagaggttgaaatacaaactcctatttcctcttggccatcaagtaagtacatcctcagcatttagatgcctctacagaggaaaatgagactcacccaaagtgggaaatgtttctctttcctcatctacttagtcatagaattttcaaaaagactcttgagcaggatgatccaacagaccttcccaaagactgacttaagaacttatcttttcagagcacaaggcaagtgagggctacccaggttttttttcagagggcaggagctctcagcacaaaatctcactgctagcagttgttcctctgggcatcttcctcatctccaagagggaaggatcacccgctcctcacagcctctaaacttccctgggtttcctgcagtctgttttcccacctccctgagtctggctgccgaaccctgtgaagctacttctccagggtagtggttctcaaactttggcatgcagttggagggcttgttaaaatcttgctgggctccatccccagtttctgatttagtaggtttggggtgggggccctagattttgcatttcttacagtttcccagataatggggatgctgcttatctgggaacaccgctttgagacctgccactcccaaaaaacctttcttgcaactacacactaattataggtgttgctgctcgagaagcttcccattcagacctgaacagagatgattcagtgtttgagccagcccccagataaccagctgcctaccacttagctaattgctgggatcaaggggttgaacagacattttctgtttcagatgcgaacaagggggtgaaaaaattaaaaagatacagggaagcaattgcaatgccactgtgcaagcttcaccagtggacgttccaattaacaatcagagagtacctgctgagcacattttagattaagattaaaaggaaaaatgatgaagtacagatggggaggggttacggagaccatcatttacaagggataaagaaatggtaagtagcttaagaatgacaacaacaataacacacacccaagatgatttactagggacgggactggctgaggaacaagatatcattttgtgaaataatttccaacgttcaaattctcctcactcttgtggctagtccctttctaaattgaatggggccctctcaattcccaccaggattatggacaggcagagttcaggcccacagcaccacagacatgagtcaatgcaataagcctaatgattctagactcttttcctagtctcacctctgcaatgttgccaaattaatttaattaaaaatgtcattcatccaccatcacggtccctgcctgtttcatatagtaactctaagcctggctaggaagaatttctaaaacctaaactcattctacatctcttactttattttctactatgtttcagtccaaacccttgccttcattatttcatgaatgtgacccatgtattccctaattttaaatctatgccttctctgtggcctcttcaactgctgattactctttgtgttcaaaccttgggcagtcttcgaggccaacctccaggcttgattcagcaaactacttgtgccctcattgacctctcccatctctgaattcccatgctactgggaggaaaaaaattctaaactgcctcattatgttcatattcaattattcttcaattcaatgtaataatacctgacaattgtataaaatttacatatgctattgcatttggtcctcacaaaatggcagaataaagtagatattgtactataatccccattttacagacagagaagcagaggctcagatatccaatcaagaccctgcagctatgtggtagagttaggatagagacccactagccttgtgccataccacttcctctccagatggagtgcagccttcttggagaggaagaggaagcataagacatagtgtctgctatctacagagcctcgcctggggctcatgcaaaaatgatgggggttgactgattcataaatccttcatagaggaggacaaactgccctagaaaataactgatgtgtctgttgggtggtctaggaaaatgcagaggaagcagatgtattcaacctgtacctaaccctaaccctgctctgtagagactgtcatgtgggacactaataatccccagaagtcctctctgggaccccgtgtggggtggtggtatcaggaagactgatcccatcggctgaggggaagttcttctgcttatagagggataactcctagttatccaactgattaaagatgaatgacccttcaagtggcccaattttccctcaccctctcctattctaggagaacaaggatgaagataatgaaagctgataatacttagacactctgaagactcttaattatgaactagatgattaataagctttgcatcccatttgatccaatcaaaataaataaaaaagatgatatcatatggatatggatttttatggaatctatctataaccaagagagtaggtctaagtgatttgaagctttcctggctacctctggatatcctggataaactgcctacactggaataaaagcatctagccagccagaatattatgagacagactaattttaaaaggaggcaagtctttgcaatgtacttcaaattagaaactgatattattattcataaaatttaagatcacagaaaaatattttgtgagctaataacaataatggatttagtgtgaatgacatgatatgaattcatcattgagaaagcaataatatttatatagaacattttctcctgaacttgggacaacaccccaagactgccctgaacctgacgggatccaagctgaaagctttgtattcttttggttttcttcatgctgccattttacttatcttatcagagctgtgtacctaagagtttatctttctaatatcgattcttctcatgtttacactggacggggcatgtgtgttcaataagttgtgtagtttttagttttaccaaacagaataaagcctcttcactttatcccagacatcatggaatagttatcttctaagatgtggtcacctttgatgggtcagtttgtggtcaatcatccatcaatagtaatgatgataacatcaaaatgggccccccttttttaatcttaaaacatttttcttagaccttgaaatgactctaatgtaaatagaaaacagtttttgttactctgcagtactgatcgattatgatcccatgccagctggttgtttaactggctttactgggaagtcatcagttatgggtttgtatcaacaggactattaatccttttgatggcagcaggcttctaattatagctctgctcagttgaagagatgtgatccaatagccacaaatatatgtattccatgttgaaatgaattggagcataccggaaagtagtataaaaaccctaacaactctttagcatccatatacactctgtattcttgagctttgagtaatatggagactcctgaaacaatgatagcagttgacttcagagcagttgtaaggctcaggatgtctacctgaataattattcctaagagtaaaacattcttctaggagacaaagaaaatgacatagattgctaacagagagaatggaatatgtcaattctttataaatttctcaataaaacacacacagatcatttgctttcaagaaactcaggtggcgagaacccttttgtttgttatgaagttcttttaaattttatctaacaagacttcaatattatatctgaactaagagtctcctttcccatcttcattccatatttcttatccacgatagacctagataggtatagcaaaagcaaaatacgggcattacaagttgacctcaaaagtggttggcagctaggtagttttagaattcaatggaagagctaaagttccagccctatcacctcctagctataggatcttaagcaaataatttgacctcttcaagtctttgttttctcttctgtaaactggggataaggttacgaattcccaacgttgttctaagactgaatcagatgactcagcactcaaaagtgatagtaatttccaaaactaaggtaataataatagtgataatagtaactgtttgtagaaaatgcccccaaaaggcaatcattcaactgaacaaaaactgataggatcaattgtttctatttttttcatttgtatctgctttactgcctctttatctggtgttgcactgtaatccaaatgcccaacaggctgtgcattgggctactgtaagatttcacaaatgcctagtataattctatagagtattaaagaagaaaaagtgaaaattatatttccatgaaggcagccacacagtctcataaatgctaaataattagccaagatttcttgacagagaaagccataagtcactttaatgagtggccacaggagtttgttattctccttttttcctagtttttttttttagagatgagagctttccttgcctggttggcttagcacggatctacataagaggcagagatctgaaccagtcatatgtcttgtaaatatctcttgtaagttttcttctctaagagcacgtactttttcactgttacacttttggaatgatgtccaagacaacctacccactaatgcttgttttctccagcttatctgcagactacaattatttcaatcacagttgttaccagagtagaattagtgttcatatttgccagcaacttctatgtaataaatcagagctaagctactacataaaacagagtctttccaaacaagtattgcttgattttagttttcactaaactgtcttaggaatcatgactgaccaattctactcactcgttccactccctccactgattctagccatcccttttttttagggaacccttatttatctagaaaaggaatgggatggagtaggtgattcaaatagcactaaatgcatatgcacttatgcacatataccagaagacagagtgaaagttcttcgagggcagggtcaatgagccatgtataggtatggagtggttcatgtgggtgggcacccacacaacgtgtacacacaaacatccccagcctcccagcacaaatatatgctctccatccaaccccaaccccactctgggaccactcacaaaacaggacagcctagatgaggtgattagaaatgggggaaaggaaagagaagagaagtcccaggtctgaatggagagctgagaatctagacacaaatgctggcatggggaatggaacctctgacccctggatccatactcctctcacatctacaggaatttagtcctagggaaacaagaatagactattcatgtaaccactacattctgcttcctatgccttttttttctggatattaaaattgccacctatgtgctaggaggctgataaacaataatctataaccagggatagccaacaacccctagccattggggagcaacagcctggagctcacatttctgaaagagagggcatcctagagaaagtagctcagggtacagtttcaaggcacttcatatcaaggcttcccaaataagaagccctcatattcatacaggggatggcagaggctcctaagagaaaagaagagctctctatttgccaaaggctggccaatcagggcacggttgggcaggtaggctggtactcccatagcataacagactgtcaaatcactgtgggacttctttgggctgttactagatgcagacttcaaaattctgtctgagccttctccagatgtttgccttggactctttgggcctcccctggtcatctcaccagtcccctatttaacttatgccttatactcccttttcttgccctcctacctggctttgacatagtcctgtcatacctggatggcatgaccctggcaatggcaccttgctatgggtctacctgtaaggatttggagtacagaagctaaaactattgaatcgacagctagaaccagcctgttctgagttccggactgacagttgcggataatgagatgcctgagacgtatctctttcttattctgaaccttagtatttcagccagtagcctaagaggtctattacagttccaactcttgtacctcttggcacatctgcactcaagcagaatggcacacaagcccctcagcagggcactcaaggtctacactaacaaagagtaccaatgctgaagacttgctgatcctgaatgtaggaagcctgagaacatctggaaaaaaaaataattatgtttaaaaaacagttgttccatttatctgctgcttcactttgacgaacagaaaacaatgtcacataacatagatagtcaccacaaggacaccagcttgtttaaagttacacatgaatttatatgtgatgctgaaggataattataatggcttatatctatttctaacatcttgaagttttgttgttgttgttgttgttattgttgttgttgttgttgaggattttttttaagaacacacagagaaagacctggtagaagtctttctgacatctggcatagaagacaattatacctttattgcacaaggaaataaaatagctgtgtcttagctccgtctttggctgacagctaaggcctggaagttttgtaagttttcctatttaggagttttgttgagagcctagcagcctcacagccaaaacggagtgtctgagatgctgctgattagaagtcatgggtctgctgagtacaaggctagagtcactccttaggaatgtcataaaggacctgggcagtagaaaccaacaccaccatggaaaatcagacaggatgagttacctttaaaacaaactgtcatcattaatagggaaaatggcaatgacttattaacccctatgattatacaatcatatcttcaagtatgcacacttttcatttccttcttgacaacttcatgaaagtaatgtctcatctcctggaacatttcttttcctttttttttctttccttcttgcttctaattaacattgaaaatcatttatttatcaaaattaggtttcccctgcccatgtttcagaaataataaatagctggctgagtatggtggctcaagcctgtaatcccagcactttgggaggccgaggcaggtggatcacttaaagtcaggagttcgagaccagcctggccaacatggtgaaaccccacctccactgaaaatacaaaaattagctgggagtggtggtgaacacctgtagtcccagctactcgggaggctgaggcaggagaatggtttgaactcgggtggtagaggttgcagtgagccaagatcataccactgcactccagcctgggcaacggagtgagactgtctcaaaaaaagaaaaataataataaatagctatttccaccatatcaatgacatccactagatttttgggtataaatttggaaagaaatatgatgaattacctgctcagtggggtgaagtgtctttctccttgcttcctcctgcaggcccttcttttaattttattgtcctatctttgaacttctctagagatgttattcctatcattataaaaacatctctgtgagaggcctaggatggccccaggaagccgatttcttaggattttctcttctgtctctgtgaatggatctctgtatccccactttctgttgggcttcagaaatcctttcattttatgaggaatcactgtgtttttctgggaaagaggaatgggtctctgtactgaagaatctcacaaaagagaatcagatgtttccttcgccaagcccccagatgaaaacgttcataaagtgagaatatgccaacgtgctgggcaggatcgcctgcctgcacaggtctgtactgtaattacatttaagctcctttcaaaaagcgaaatgctcccattcaaaggatctttttactggttaccaaaagaacatgttatgaaattctaagcaaagtccatttcaatataatacatgggatatggttaatagaataggaggaaaaaggactgtgggaagagcttcaatctactaagcccccagattgtagaagatcagatttcatgaagaaaacctaaaaataagataagaagcattcggctttgtttcattctgactgcttagtgcctactcttgggctaagggatgctgacaagctagtatcatcaagaattgtctaggaactgttattcctaccctaggattatcacagcttggaatgcctcgcctttcatttttctcagcttacaaccaaggcatgtctaaaatgcaaagtatctatttgaaatgacaaaaaaagaaatgcagtgagaaaacagatcctgacagttgtgttttataaaagtccattctgagaatacaagaaagaagtatacaagtttaaaaaaaataaggaaaagaaagcagttttaaagtaagtcattagacagccctaaggcaaaaaaaaaatatttcaaggagagaaaatgatcacaatttactaatcaatgatgttgaatgcagtgccaacatgctttaacaaatgcgatatttcttcctagtagtaccatttcatttcttttaaagttgaattaatagttttactaaacactatgaaaacgatcaataattgcatttcctgaggcatttagcccaagaagtgcttttaaaaggtatatctttttatttagatatttgttagatctaagcaaaatcaaatcaggtaacattattcagaaagacatgaaagggtatcatcatcctggtcacttggtgcacacccaggtggagtcaggaacatgtaggactgatgatcaggtaggttgttacttggaaaactggtcctagcttctaattatttgtcattagtctttgctcagcataaacctaaaaacgggagatttatctctctcttttccaatgtcctagtcttgaattttcaagggacatggtggcctttgtgatatcacagcaaactgagggcccacagggatgatccaggagaagcctcaggcccagtgcttcagtgtattggaatgctcgctgctttaattcatgcatgcgtccagtgctcaccacgttcagggccatcggggaaagcacgtcaacatgcttgggcagtgcaggaaaagaatctggttaacctggaggcgacaaccgaaagggggaggttgcatcatgcaaatgaaaaccacagcttggccttagctgccatgcagaaaggacctacatcaaagagtctgcagtgcggctcctgggtaagagtcgatatgagagaggtgagttacttcagcaatgagagacacaggcagaaaaatgttcaaaccactctaaacagaacactgtacagagcgctggcattacacgcgagaagaggcagctttggggacgaggaggggcgagacagagggaaggtgaggacagaactggccgttactcaatgaaatggcttccctggccatcctttcatatgcatgtatttttataatgtatttcacttcaacaaataacctcatgagagtttttaacatcaaccataattgttaagatgttgtgaaaattcaggagaaacaaggcatcagttacataaagatacacaccatggtttcctgtagttacagttcattatagaagcagagctgaagcgggtcagataaataagagacagttaagtgccaacatccttaacactttggttacagagctcatgatgactctcaaggcgtaatgtagtgttgaaggaacccaacagtcgtgaaagctcgggtggtgcaagggtagggactctatgcatctatacccctgaaagccatttataaccctgaagttaaccacgctctcaagtgaagccatcttttcttcatctcagcatgaatgacaggtgaacagtgagctcacctcatacatattgaccatttagcagaaccctagttacgagcaagattctcaaaggtatttcttatcaaaatcaattcatcagcaaaaagcatatatatgtgatatatatatatatatatatatatatttcttaacatttctcttaaaggagtaataatactgttttaaattcagtagagattcatcaagcttcgctctaatgtcaaggctacactggatatctaaaaactagtttcctgtaaactccctgcttaatataaggcttgttatcatttttcttgcctcttctgccttttatgatctctggtacattgaacacaactcaaaaaatggtacggtctagtcctaactcacaattcctgcctcctagttctgacaggggaagagcaagccccgtgcttataaattactccttctaaaatgttctccaggagttcagccttctgattccctgcgtgtatgatggaggccttgatagggaacttaggtccagtgtgaatgagcagtgcactgcctcactttccacactcagtgagaccttaacatacccactgaaacttgagcaccacccagaacatgggagtgaatgcaggtagaagcaaaacacaggattcctcccgacactaccttcctcattccttgagatgcagctgtttccacttgatcacaatttattctctcttatagattaaaaactcagaggcttagttgaatgacatcttttcaaaggattatctttttgaacaaaaacataatagtctgtacattcattcaacaaatgtctctgagtttttttctttggtgacaggcactatgctggttttggagacatataattcaataagacatgattcttgctctggagtagttttccatttagcagagaagtctacccagattttaatttctggcagcagatatgcaagagcagcttgtttaaaaattctactgattaccttgtatgaccttggataagatatttaatcatgctgtgcctcagtgtcctcatttataaaatgcaaataatacctacctcctgaggttgttgagagaaataaatgagttagtaaacgtgaactgctttgttagtggccagcacatgatggatgctatgtcagtggtagctattatgatcagtagtactcaaatataagtaagaagcaaaggactctggaagcagaagatcgcctctgcctaacttttgcagtaggccttgagtgaggattagaaactcatcagcgtgagaaggcaggggaagggatggaagcagagggctaagcttgggcagagagacagaagcacagagaacacagtgcattctgggagtggaaggacacctcgtatagagcctaagtagattgtaaggttggcaagaaacaaggccagacaggagacggtgaagcatctgtgtgccctggaagcatgtctgctctttatcctataggaaatagggagctgacagaagtttatttattttttatttttattaaatctagtttttgagacagagtttcactctgtcacccaggctggagtgcagtggtgcgatcttggctctctgcaacctctgcctcccaggttcaagcgattctcctgcctcagcctcccaagtagctgggactacaggcgcctgccaccatggctggctaatttttgtatttttggtagagatagggtttcaccatgttggctaggctggtctcgaactcctgacctcaggtgatccacctgtcttggcctcccaaagtgctgggattacaagtgtgagccaccacgcccagcctgatagaaatttaaatgctggagagtggtaccattatcttgtcttgtagcaagttaattctggggacaatatagagtaggaattggaagcagaaggttgtgaagacagaggtcaattagtcaaattaaatccccacggaaaaaagtaacctatgcacatactaagatgagcatcattgttgccatataattacagtatcttaatatcctgggaaataccccttcttcagggcctgctgctgtcagagttctttaggaagaggggattaggtccacagtatcactgaagcaatttcctaaaccacatggttctctctcctaccacggcccccatgtctattgcaggaatctgtgtcatgaagaaatgacagcacatgtctcttaatcttctggaaaaaaaaaaacccaccctagtaagaagctgttctttctgctatttggagagcagtctctaaattatagttagaatcgacataaaatgaacatatttcagtacctcaaataggggtacctggacatagtagacacatgccaacaattatagacaaattacagataacagattatagacaaattgtatacatgtgatcacacccaggcacatagaaaaattacagtgaacacttctgctgcatccactattaattacctaaagaacttggttagtcataccgtcaagccatcaacttaactgccttttaagtgtccatccaaccctgtgcacagttaggatttcatgagcatgttggactggttttctctcacagaatcctgacctttagatttagatgtccttagtttccagagggctgcctgaaagtatgaattctggggtgtgcagggggtagggggtgaggctttcttttggcaggagttgacaagaggaaagatgccattttcaggtaatgtgctttctctttaaaaagtgaccaagtgtgtttgatactcacttagctcaattttaaccgtggtgggagctctgtaccctatgttggtaaatcagaaacaggaaagttctgtctgtgtgctgctgtgaccatgcggtcatatttgtttggtggatttccatttgttccaagtccattctagtttggagtttccatgaagccaggccaagtgtacaaatgctaacacagggaaaaagaaccctctatacatggacttacggagaagacaatacacactgaacttggaaaaggagcacaggctgagattccctaaagtggcagccaccttgctgcacagcagacactcagggagatgctccaggcagcaattgctcagcaggaaggcatgctggggaaggacctcatttcaaaggagagtagaacaggcctaagtgctgggattacaggcgtgaggcaccgcacccagcctgaaattagtattattttaaagttcacgcatgtgaccttataaaaatgttggtgcttatttttaagttatttctttttctttttaaaatttggtttctcacaagagaatttcattgtgctgatggaagagttctgtatactgactggagaggtaataaaacaaatttatgtgggataaaatgtcttggatctacacagcaaaaaaaaaaaagtgcttgtaaaaactggcaaaacatctgtacttgagtttacagcagtacgccaatatcaatttcctggttttgataacataccatgcatgcctatgtagcatatagcactatcatggggaaagcttggaaaggatacagaaactctgtcctgtttttgcaacttcttgtgaatcttaaactatttcaaaatgaagttctaattttaaaaaacagttattctcctgtttggttttactgtagccagacatcaggctagtggtctatttctggtgatatgtgcctctaaatgtctacagactgatttctttaacaaacatttactcagcacctgttataggtataatactgtgttcaattccaaaagatataaaagagggataagaaaccacagtgatacaaatcaacattaactatcttagttcctttctcaaaggagtgctaattgaggcaaagacatcatttacctactgcacaaattctcagagacaatcccccaagataatcagctgtcaataaatgtaggtcgttaatgtaataagcaagcttctagaattaacccacagtaatctcttcaggtaagcagatatcaggtaacaagctgtgctgaataatgcaactgatgtgataatgactctcttccttcacgtacagttggtgcaggctaagccatccttttccttagtttttcagtccctgttttgtccttcccagaactcagtgctcaccacactgaggagccaacaagtgatacctgcttaatgaaggtgcagggtgacactaagagctacttagattttaagaaacaactgaaaaggcttcaagaatgaatgtctaattggtggaatttcaggtactttgcaagttagaagagatgttttggagtataggagtatttacagcaccctcaaactcacccaaggatggccatctaccacactctctactaaaataagttgtcatgggcaattatattggaagtaaagtcaaggccaaatgaggcaataaggatggatccttagaatgccaaagactttgcaaggaacatgtcaacagtttttatcattctgagaagctgcctctaacaggaacaaaaagaaaacagagaaatgtgcaaagaataaaatctcctggaattgaagcctcagcaaatgaatatccaggaagagccaattcaatccttcctgaaatagaagatgtgtcactgctgttaacctgacaccgttattacctgcaagtggcttgggcttttaagaagtctggaagtaccatctttttcttgctgtttaaaggataaacaactagaacagctcaatccgggaacaaatgaatttttcaaagcattccccaaagaactgggaaactcctgctatgaagaagggtcctatcctaatcacaacaatttttaaagaagttttgtaacagtggaagacagaagactcccagaaatatttgacatctgtaagaatgaacagcagctaagaatggacgggctgctgcattcactcctctgtttcacacccatgctattcccttgcaagctcttactcatccacctttgaacactcaactcagtggctgcctcctccagaaagcctcccctgatcctcctcccacccagaggtaactgaacctttttctaggcttttcttcctgggtgcttctgttgtggcgctcatcactcatgaagtggtaatttatttgtttgtgtatctgtctcccttccctgctagactgtgagctcctgaggggagagccttggtgttttgtgtctgggttcccatcatcatggtacccgcaaaataggccctcaatacatgtttaaggaggaggagaaaaataaatgaattgagggagaaaatagacaaacctggaggaaactgattataattcaacagtaccaagatactagggaagtcccatctcccaacatggtttcaaatggccccatagtcccataccaattcagaacttaaattaggctaggcgtgatggctcacacctgtaatcccagcactttgggaggctgaggcgggcagatcacttgaagtcaggaatccgagaccagtctggccaacatagtgaaacctcatctctaatagaatacaaaaattagctgggcatggtggcgggttcctataatcccagctacttgggagactgagtcaggagaatcacttgaatccatgaggtggaagttgcagcaagccaagatcacatcactgcattccagcctgggggacacagtgagactccctctcaggaaaaaaaaaaaaaagaaagaaagaaaaaagaacttaaattatatgacaattacatcagttacaatattactacaatccctagaggatgaggtgcattcaaaggactgatttgtgtgctcttcccgtgtttcaggggagtttcaggttatctcacctcatgtgtgcaagaagaagaatgggaatgaccttggaggtaacaagattcaccactcagcaaagccatttgacctcactagccatgagaggtccaagacctgagaaggctatgggatagttaaaattccacaggagagtctccccgagggcattcaatttctgtgtcattaggcatcacaaaatctaaatgcctaaaactaaaaaaaagtcattcctctgaaactaatgagtatgcacttttctccttctatgagggttatcttctataactgggaaaccaagattgaaatgaagttgcccctgtaaacattataaaattaatcagggaagaagaaaggggaaaaaataaattaataaaccaagcttgaagcacattcagcattaagcatgaggtcaactcattctctgacctgcttcctcgacatggtttggtgcctattgtcctagaatcatgtagactctgtgataagatgatagttccccttaagtgctctatagataacaacttgaacattaagaaatgttaagctttccccgtgaggtagtctttcaggtcctgcatacgagtgaaactactacatcagctgatctgaatgaaagaccccacgggtgaccccaggaaggtctgaggaacaccacaagaagctgactcaccaaagaacacaatttccacattctgatgatttaatcccccttcccctgatcagtcaacaaccccaattttccagcccatcacgctccatgatgttcttaaaaaccacagcccagagctcctcagaaagatgaatttgaggctctcctcccatctcctcccttggtgccctgagatagttaaacccttctctgctgcaaacctgctgtctcagggtaatgggtctgttactatgcagtgggcacacaaacttattggttctatatcagaaataatacacagaggtgattgaagccccagttcgttcttctctctttgcttcaaatgatatatttttttgtgctctagctcaggaagctggacctaaacttgacacgaagcatactaggagcaaagctaaaaatctagagatgtgtgcatatcaaataggaggaagtcagctcatgtttctcttgctgattcatttctccaggaagccaacccaaggaatcaggtgttcaagcaacaatggaaaaagatgaattaaaatctccacataagaatacatagatgaagaggagtgtgggtgaggattttaacccaaagggtctccttggagagtaacttatcttactggatataaatcaacatgctctaatttttccagtaaggctgaatatatttaaaccttcaaaaaatatagtaatttttaatgcagtcttagattgatgaaggtttcttatagtttttactccatgctgcatatatgatgaagattccattaggaagtccatctgaaccaagtatttaaatcacttaacattaactttcctttgaatttgtcctctcatatcagcctagattttgataacctgctccttctagtcatcactctccctaaatataaaaccattttttaaaaaatcaggacgactttttaaaagtctatgaaattgtaaaaatttgtagagttatcactagcttctgaagtgacacctctgggtaggcaattctacaaagactatttgtaactatatgagctaatagtatagaagcagtgatgtaaaactgtattatttgtttattatgagcaacagaataatggaatgaattaatgcaccaatctcgctctaatgaatctatggacaacatgacagtatggtgtgaacagaacaaaataaaaccattgagtgggtccatttgcaaataagcccatttccccataaggcgagagaacatttgtttaatttaaagcttaagaacaatctctttacatacaaaatactttttctcagttaaaaaattataagtgctaagacaattaaattaatacagcatcaccatttttaaaactgaaaaaaagaggtttaattaatctcattgtgttctaactcactgttaaatcaataaaagagtttgaaaaaaatgtgtcaacctgacgttggattcattgtttttctatttagtagatatgtttaagaattcattgagtggtgttgtggagtttaaatgagttaaaacaggacaagggcttagacagtcactggcactgattaagggctcattaactgttacctgttgtcaaatgtaaagtcatgcgccaaacttctatctgctcttggtttttcgtctaactgggaactggacctcttgcctctacgtaagtctcctaccacccgtattactctctctctttcccactgagctctaaccatactcatcttctttctgtttcttcaactgtccaagtttttggccatctccactggaatgcaaggcccataaaagcagaaaacatgtgtgttttgttcactgtttcaccaaaacctacacaagtgcctgacacagactaagtactcaataaactttgctaaacaagtaaataaataaatggagagccaaaggaaggaataaagggaggcagggagggaggggggggcgggtcttagttcattctcactaagattaagtctatggtcaatactagtttgctagtgtttcctttatcaaaccatgcttgttattaggatcaggctgctcccacctcacttcctatgtctatatgatttttttgtactcacaaaaaggattttcctctcttgcattccaacacaaggagttccttgacaatttaatattatataatatatgcacctggaaagatgtttgacatctaatttttgacttacacttaaccacatatttccgctttcatttgaaggcaaaatggaacattttcttgtcaatttttttttctagattatgtgaagaagaaattaatagtcttgtcccatgttaatctaaagctcttctgattacataaatttaatagaggactctccctaaacaaactttaattccacacttaaagtatctttacaatgacaaaattgttctgcattctatagatattggaatataacacattgcataatttagaggttaagaaaatggactctggattcagaccaggggttcaaactctagttcctattactaaccatgtggacattgaaaccttctgaggtgttctttcttcatcaagcaaataaagaaaatcgtagtagtgctactaagtagaataataagtttgtaaaaggcttatcatggcactttgcacctagtaagtactcaataaatacagaagctgcttgtagacctagagagagcaaactagaactaagatcagaatcccctaatgatagccaggcaagccagtacctgacctattgaacatctggtagagatccactgagtgaacggctgctactggtgactaactgcatgacagcctttccttgtcttcctcgctaatgtctgttcaggttgtgtggcccttcctatactgatgtgatgtattttgtagaatccctctccttgagcctgtgatggccaaaattgcgtgcataccataaatgcttaactaggtaaaatgcctttgtaagactctgatgttagtccctgctgacaactttctacctcactacaatccactttaatctttgcattgacatttctgtttagaagagcaagccaggaatgatggctctgggctgagaatctggaatgcagattataactgctcagcaagttcgcttgctttgtgtaaactggccgcacttcttttgtcctcatttggaaaatagctttggctgcttgatatcgccacatcttccattttacacattctcagtttctgacaagaaaagtagagagtggaatgccacactgttgcaaatctgcggatacgcatcagcttaaccttatttgttctggtggatttttgtagatgagaatgaatatttgggctacaaacttccagcttgattcccttctcttagttccaatttcccagggtttgtttgctcaaatgcccaatgtaagagcactactctattctaggggccaccttccactgctgtgggttgacctcaacaggcattaaacctgtatgcagagccaggcatggtggcacatgcttataatcccggctccttggaggctgaggcgggacgatcacttgagcccagaagtttgagactgcagtaagttatgatcacacaactccagcctgggcaacatagcaagaccttgtctctaaaaataaataataagtaaataaaacgttttaaaaacctgtgcgcagaaatgaaagcccatgaacagcaaaaaaatcaaatgcaatcctggagctatgcataaaccaaaggagagatgaatatgtctagattaaagttctttagcatctactgtccatcttatgggattccatagacaaacatacagtagaaaagctcaaaataaaatggctttattctatatttaaaactacattttttccttatttgtgttattgcagactattagtttttcatgcacaggcaagagctaaacaaatacactgattccccaatgtgaccctctatagcatcaagacctatttttatagcagtgtaagtacatgcaccaactattatgtgttcttatgaagtaatcctcatcctgtcaactgctgtaagatcctggggaacatgctgagcaatgctggtgttctatggttatgcagtacttggccaagctcagtgggtaatttctcctaagtatatatatgcttaaatggcacctaccaattatctctctttggaagagtgcaagtgtagcatgcccactctcccagatgtgtgcacattcccgcctccacagagctgtctcttcgcctctcctctctagaagctctgggttagtcctttctccaggcacagaggcagctgagtgaactcagcctaggggagctatcactgttcttttcttacctctaggagttacaacagagaaaacctgttctccagaaaaagaccaccctctacaatgtcttcataggaaaaaaaatggtcacacctgtgacacagccctaattgaattcttataggcacctcagatcaaagctacccaataacctgaggtaatggaaaagaaaaacaatagagtatgacatttattcatgtaccaaattcttggtttctcacctattaatttttggtcttgcaaattttgctggaacagaacatgatagagtactggctctgaagttctaggttcagataacaaactcaaaaggggtttaggaaactaatccaagggagaatcataaatttgaaccttaacatggactctgttctccacattaaaatatattgtactaccttttttcatataacatatcaaagaaaccaagagttggctcttcgaaagaatatacaagaatgctagacagctggccagattaacaaaaaaagaagattcaaataagtgcaatcagaaatgacacagatgacattacaactgatcccacagaattacaaaagattctcgaagactattatgaatacctctatgcacataaattaggaaatctagaggagatagataaattcctggaaacacacaacctcccaagattgaaccaggaagaaagtgaaaacctgaacagaccaataacaagctctgaaatggaatcagtaatttaaaaaaaacctaccaaccaaaaaaaaaaaaaaaagtcctggaccagatgggttcacaaccaaattctaccagatgtgcaaggaactggtaccaatcctactgcaactatgccaaaacactgaggaggaagggctcctccctgatgcattctatgaagccagcatcatctttataccagaagatggcagagacacaacaaaaaaagaaaaacattaggccaatatccctgatgaacatagatgcaaaaatcctcaataaaatactggcaaatcaaatccagtggcacatcaaaaagttaattcaccacaaaccaagtaggctttatccctgggatgcaaggttggttcagtatatgcaaatcaataaatgcgattagcattataaacagaattaaaagcaaaaacacatgatcatctcaatagcctcagaaaaagattttgattaaatctaacatcccttcatgatagaaactctgaaaagagtaagcatcaaaggaacatacctcaaaataataaaaaccatctatgacaaacccacaaccaacattatactgaatgggcaaagctacaagcattccccttgagaagaggaacaaagcaaagactcccgctctcattactcctattcaatatggcattgcaagtcctagcctgagcaaccaggcaagagaaagaaagaaaaggcaaccaaataggaaaagaagaagtcaaactacctctcttcactgataatattactctttacttagaaaaccctaaagattcttataaaaggctgttataactgatcaatgattttagcaaggtttcagaatacaaaatcaatgtacaaaaatcagtagcatttctacacaccaacaacatccatgctgagagtcaaatcaagaacacagtcccattgacaatagccacacagaaaataaaatacctaggagcacagctaaaaaaggaagtgaaagatctctatgtggagaactacaaaacactgctgaaagaagtcagagacaacacaaataaatggaaaaacatttcatgctcatggataggaagactgaatattgttaaaatggccatactacctaaagcaatttacagattcaacactattcctatcaaactaccaataacattcttcacagaattagaaaaaactattctaaagttcatatgactccataaaagagcctgagtggccaaagcaattctaaacaacaaaaacaaaaacaaaaaaacaaagctggaggcatcaaactaccaacaaagctggaggcatcaaactacctgacttcaaatatactataaggctacagtaaccaaaacagcatggtattggtaaaaaaaacagacatatagatcagtgggactgaacagagaacacagaaataaagccgcacatctagagccatctgattttcaacaaggctgacaaaaacaagcagtggggaagggactctctattaaataaatggtgtgggtataactggctaaccatacgtagaagaatgaaactggactcttacctttcaccatgtacaaaaattaactcaaaatggattaaagatttaaatagaagacctcaaactataaaatctttgaagaaaacctaggaaatacccatctcaacatcagccttggcaaagaattttttactaagttcctaaaagcaactataacaaaaacaaaaattgacaagtgggacctaattaaactaaagagcttttgcacagcaaaagaaactatcaacaaagtaaaaagacaacctatagaatgggagaaaatattcgcaaactatgcatctgacaaaggtctaataactaggatctataaggaacttaaaaaaattgacaagcaaataatcccactaaaaaatggacaaaagacatgaaatgacacttctcaaaagaagacatacaagtggctaacaaacatgaaaaactgctcatcatcactaatcgtcagagaaattcaaatttaaaccacaatgagataccgtctcacaccagttagaatggctattactaaaaaatcaaaaaacaacagatgctggcaaggctgcggagaaaagggaatgtttacacactgttggtgggaatgtaaatttgttcagccaatgtggaaagcagtttggaaatttctcaaaacacttaaatcagagctaccattcaacccaacaatcccactactgggtatatacccaaaggaaactagataattataccaaaaaaacacatgcacctacatgctcattgccatgaaatttcacagtagcaaatacattgaatcaacctaggtgcccatcaatggtggactaaataaagaaaatgtggtacatacacatcatggaatattaaaaagccataaaaaagggtgaaatcaagtcttttgtggtaacgggaatggagctggaggccataatcctaagcaaattaacacaaaaacagaaaaccaaacactgcgtgttctcacttataagtgggagctgagcactgagcacacatggacataaacatgggaacaatatatactatggactactagagaggggagggaaaggaccgtgggttgaaaaactacctattgggtactatgctcgctacctgggtgcaatatattcacataacaaacctgcatatgtaccccctgtatctaaaataaaaactgaaattaaaaatatatatttttaaaagtactgtatgtatactacttttaattatgaaatgccaatttgttatattctctctctctccttctctccctcccctgctcagtgtctcttgctcttttctctctcttgctgtcttctcttccctcttcctcattaagctgtatggttaaggaaatgagagcaatctctgcttcaaggcacagccaagaggaatcagcgctcttgactttgacatcttcaattcctactaccacacttcgtcagagaaaaaaaatgacaggaaacttctagacaagatgattccctgccattatccttaaagatctatccaaatcacatcattcctttcacttgctaattggtttcgtaagccttcttcccttccttatgttttctattcttatttttgggacaattgccgacgtatgcatagttctggattttttttttaagtaatttgtagttgactatcgtttatttctgcaattggtgtaattaaatctaattacataatcggtgaaagactgagtaattacataattagaatgtgcaataataacagttgaaatcctattgttatgacgtgtaatgatacaattatgatgtataacattcacagggtactctgcaacgagcaaaaacggctctaaccctggctgaatggagcacagctaaagttggagacctggaaagtagctttcagcacctatacttggacttgcttatcatccttatccccctaatgtatcctttgacttttatactccacaggaatcaaaggcagtaggcgaggtctaaggaaggtcctcatgagggcaggagcactcacatctccaagaaccaaatcaccaatacaatcagcccttagacagaaaggagcagcaagagatggactcacatttctgaaacagtcactcctgcatgtcagttttaagtttgaaactgtaatcaggagacaaaaagttagggttggagaatgtctggtgatcacacacacaattacaagtgggcctagtgattatggcctgggacatagctcccagctctcagtctgccctctccaccccaactccagtcatcttaatcaccaggacatagaccaaccaccagaagtgctggcctcccaggtccttgctctgctgattgtcggtgaccctttcctttcctccacgccacccacccactcccatgatcttgctctggacccgaagaaagcagcaactatagtgtttctgatatctcggcctcaaacaccccattcatcaacagcaacctctcatccttgtgctcgcctgttcacgtgctccccactgggacccttccccaacctcagagaaatctccaaattctggacacctcccccgacatcccacccctggccagtcatctgctccctgccttgccttgcaacgctccttgtccagcctaattcccatagtccaccattgtcatcacccctgggcagcaccctccttccataacagaagccctcagccctacttcacaccagctctggaaagctgaaagttcctgaataaaaccacacaagggaaatgactggtttcgctttaaattcatgatctcaaactgcaaattgacactccatactgactggcaaactgctatttttcttgaattggtttgctttccaattttccaaggccactatttcacagttttccttctctcctccaacctcccatgttcttttctgcaccatcaggctcagtggatggcctcgcctcatcatgtcattaaaagtcacataaaagaatcaggccagttacactttttttcctaccagcagctctccaacactgcacttacaggcgcccagcacatcctctgcctcttcattcataacacaccatgccctccacagacactctttcagccctgtactgtctaactgtactgtgttgctatagcaagctctcccttgctgctggagctctgctgccaaaatataagcttgctcaactgtcctccatagccaaccacatttccagagactactgcaggctccatcctttagcccactttgatcaggccctccctccactcactagagcttcaatgtcaaagaaaccagcaacatccctgtcacaaactccacagatgaccctagacccttaccttccctctgtctcaacagtgcttggcaattggccactccctctgcctgaaaccctctcctccctaggcttctgccatctccttgccctgtgtgtgcccttcctcagtttcccatccagcctcctcctgctttactcaccctctaaatgttgggcatcctcttgccttcacctggggcaccttctctcctctccctacactctttccccagatggtaccatcaactcacaggcattcaaagtcatctttgtaatttccaaatgtaatatgattcctctcttctgagttctggactcaattatctaccctgctgtttgacatcttctctttcaggtgtcacagacttcttaaactgaacatatccaagatggaaatcctgatttctccctagtgcagcccttagcccccagtgcagcccctcccttcccagtaaatgctaccaccagcgacttgtcattgaagccaaacactagaaggctagaaggaccctgattcctccttccattcactccacatccaattcatcatggagtcctgtccaaaatgtctttctcctctttaatttccctacttcaccaccccactagatcaggccagtgccctcttctgtcgggatggtcttttctttatcttctgaacatgattacagattgcacctgttttgttttgttttgttttgtctgtcttttatttttgcttttttttttttttgcctgtctcctcctctagactgtgttccctgattacatttattgttttacttatttacagtttccagcatagatcaggtaattaactttcattagataaataaataaatgactatggtattggcatctataatatgcagactatgagcctcatggtaaacttataagggccaagatgaaagccagggccagagcagagataataaacttagctgaaagctactcaaaaagttaaacatcgagataccatatcttgatgtgctatgaactggattgcattcccccaaaattcatatgttgaagccccagtccccagtgttatggcatttggaggtggagcctttgggagataattaggtctaatgaggtcatcataagagtggggccttatgatgggattaatgtccttgtaagaacagataccagtgagcagtgagcttgcccctcccccccacctgtctctctctctctcctctctcctctctcctctctctctctctctctctctctgccgtgtgaggacacagcaagaaggtggccatctgcaaccctggaagagagccctcaccagaaattgaccatgctgttgccttgatcttagacttcttagcctctatttctatcttgaaaacatcatgctaattgaaagaaggaagtcacaaaaagccacatattacaaaattcaatttatatgaaatgtctagaacaggcaactctatagagacagaaagtagatgagtagttgcctagggctgagaagactgggggactgggagaatgtggaatgattgccaattgatatagggtttctttcgggggtgttgaaaattttctggaattagattgcagcgatagttgcacaaatctgtgactatactagaaaccactttaaatgagtgaattctatggtatataaaacatatttcaataaaactatgaagaagaaggggggaagaggagaagtgggaaggaagggtgagagaagcgggaggaagagaaggcaaacagcagcagctcaaattagttaacctagctgagttagtctatggaatctaagttgccaccaacaaaaaagtaagccactgctttatatgccaccaagaaagaaaatatttaccaattatagccataagaagtcatgaatgatgagacacttcctgattttggagattttaaactatgaaaaaattgtatcttagaattagtaaaatacagtacacgtagctgttgtcagatctaggtaccagcttctgaaggcttctaaatttgaattacttctttaaagataatttattaaccatgaactcattcattcataagaaaaaattttatcaaatgagtattataagctggatattggctttatatatggttttgactctgtgcacatcattcatttaatcttcaacaactacccttcaagataaacattatattcctcattttatagataagggtgtgggctacagaaaggtcccatagttcttaagtggcacagccaggatcctaagccatgtctccaggtctctgctctgtccctgtgttatgaatgaacagttcagatgcagaaaccttgtgagcaaaaactgaatttttggccaggtgcaatcttaatcgctcacgcttttaatcccagcactttgggaggctgaggcgggcggatcacctgaggtcaggagattgagaccagcttggccaacatgatgaaatcccatctctactaaaaatacaaaaattagctaggcatggtggcaggtgcctgtggtcccacctactcgggaggctgaggcaggagaatcgcttgaacctagaaggtggagattgcagtgagctgagatcatgccactgcactccaacctgggtgactctgtctcaaaaaaaaaaaaagaaactaaacaaacaaacaaaaaaaaactaaatttttttctaagccaaatgtttcctctgtcagctttagagatgtagatgcccatcaatcccatcatctcaggccttacttctcacatggccaacttctcccaacatcaactggtatgtattaaaggaataggaattacagtacatttctggagaatattcttggccaccctggaatttcctgcattcaatatgttggtttgccatgaagtctccaggagctgccgaatgaaaacatggagatacttacagatgacacagacagaacaaagtggaaaatgagaaacaaaaggagaaaaaaagtggtatgaagtgcagttgcacctcaatttatgctgcagatgctttcttgaaaattatgtgtagatcaaattgatttatgaactaaaccctatcataaattcaacaaaagcattgtgatggaaacttttgtaatcagaaaaatttatttgtgctgagaatagttgattctcagcctctcttttgaatttacttgttattcttctcaaggggagcctacctgcacataaaagttcgataaccaccagggattcttgatgtgcaggaatgtcatgagaccaaaatgctttacaaaggcttaaaaatataaactatctatgccatttataatagccatttccataatactttaaatatatatctcaacataatgggagggttgagaagatccttctcagggatggaattctaggaccactattgaaggagattatttgcgtgggtggggaagttcagaggagataagtatctcccctgggtaaccaaaagccctgaacccttctctcttgacagttgagagggagggagaagttgaaggagtccagcactccatttccaaatgactcccatggcctccttgcaaattacaacgtcactagctccctggtcttccatagccaaaggttacaaaatggccacccatacaggccatttaaaccatttaaaccatttaaaccatttaaaaccatacaggttttaaaaatcaagtgttacatttcttaaaatggatttgcagaattacttgaatgaataaaagatctgcaagacatgctccatattcccactggggaataactcactggagctgggtagatgctcctgaagacgtgtctcctggtccccactacttcttaagccttgcatccagcctggctcctgcaggcattttcacttgcaccccagtagaagtctcctctgagctaagggtcaccaccacacgactcacccaatcccatgtagagcccgcaaatatccatgatcccaagagcatcctttctttaatgtggtctcatttcaaaatatatgagactgttggatttatttatttactgatttatttatttattgagacagagtctcactccatcgaccaggctggagtgcagtggtgcaatctcggctcactgcaacctccgcttcctgggttcaagtgattctcctgcctcagcctcacaagtagctgggatcacaggtgcacgccaccatatccggctaatttttgttttttgggtagagatgggatttcatcatgttggccaggctgatctcaaactgttggcctcaagtgatctgcccgcctcggcctcccaaagtgctgggattacaggcataagctactgcgcctggccttattttttttattatttaataaattttttagagctagcccaaattctttcagatcctctgttcttgaagtgccctcctggttcatttcgtctagtgacaaatatgactccatatcaccactttcccagagaatcagcacagcagccatgcctccagagcttttgcttcacagacatgcttaataaattcactttaccctttagaccacagggcttagaaaggaatgttgtttttgttgttgttgttattgttctgctttccatcagcttaatacaatcgtgacgacatgcttctaagaaggatcctaagacgttcatttctttgaagcactattaccagtggagctgacaacaaaaagttaatagacataggactcaggcactcaggctcactctgcttaaactagcggagtggggaagaagagagacgtgtacattccatatccataccagcctggggtcttgggttctaagaggggtggtggcttttccctgagccctaaacccagcagctgcagttagtgccaaagattatgagggtacagaaagtaaagaaagatcagtgttttaaagtctccacccaccatatgatttctcagaaacctcaaatgtcctttgttgttgttgttcgttttgttttgttttgtttttgagatggagttttgctctgtcgcccaggctggagtgcagtggcgcgatcttggctcactgcaagctctgcctcccgggttcaagcaattctcttgcctcagcctcccaagtagctgggactacaggcacccaccaccacacctggctaatttagcaacctcaagtcttaatccatataggaactgtaagaagactactggtttgtttctcatcactaacatggtaactcatgattgccgaacactggctgagcagtcatgctctgcccagtggcattgttttctaagaacttaagtgtatcttctcattatcctcataaaatccccattatcagctccattccacaagtggagaccttgaaacttagagagcttaaataataataataactaaaattcatgaagggtgcccttctagcccactacacataccaggcactgttctgagtgtttttatctgttgactcaattaatcctcataacaccctttttgtgttactatttatgttgtcttcatattacaaatgaagaaactgaggcacagggaagaggtgaaataagatcacttagctggtgagtaattaggcagaacttgaacttgggcagcttgacaccaaagctgtgcttttactgctaggctgatttgctcaaagtcacaccactggttaaggctggagtttgagtctactccatgtggtcagaatctagagccacaggggcagccatgtgctctgcggcctgcttagatgttcatggggtcagatttcctctgcagtggctccaacggctggcagcagggtctgggatggatgtactgcctttctcagagctaggctgggaaaaacatttccttgtcatttattttttaaatgtcaggagattttaaaacttctaggagagcagataagtgataagaagaaaatctgggtcgtttttgtgcatacaaaggggccattctaatagtggtttcaaggggtcttttctagacaaaaggggaggagattgttttagtagccctctcttcctttcctggggagtttgaaactatctagttttgaaatctaaaaatccccaagctcttggatctggtcctttttacccccttagccatatattccagtttctgctaaaaaaagtctgcctcaagatataagtgacatccaactgttggggctgttttctcttttcatagaaaccagagcttctggggttctgagatgtctctagcggtcactgacctaaccattagcaactgggttctacaaataatgtccctggggaactcaataaaattatcaatcgctagcccccacaggtcttaatagagagtggataggtggaaggtttataaatcaggatgagtcatttgattcaccaagggaaaagataaataaaccaacactccaattaattttaacctgaaaagaaactgctagtgaatggtgcgttagccaagtccgtagggtcttaacaaccttaattattcacaaatgcaaattgcttttactgcttgctaatttcttcatgtcttccatccagttcctcttcccctcaccatcctcctctctcctcacccagtctctttattcctgaagagccaaaaggaaatttctggaaatgaccttctaatcactcaagctttttctctaaaaaaatttaacgaatcttcccaagaccctaattagcttaacctgggatccaaggactgccctaggcctaaataatccatagatgcgcttcagggaccccatgagctagctgaaattatatgcaaaattgtgggggtgggtgcaaaaaaaatcagaaagaatgaataagacctactatttgatagcacaagagggtgactatagtcaatagtaacttaattgtaccttttaaaattaactgcaagagtgtaattggattgtttgcaacacaaacgataagtgctctaggggatggataccccattctccatgatgtgattattacataataagtgcctgtatcaaaacaggtcatgtatgccacagatatatacacttgctatatacccgcaaaaattaaaaattaaaaacaaacaaaaaattgtgagggtagggtacttcctggctccctgcccacccaagaggtccaattttcatcaaattctcaagaaagtctatgttctccccaaccccctaaaacagcattaagcattaaaggactagactgtacccacctaaacactgcatcacaaggaatatttatgatgcagagtgagacagcccaggcttaggagccagacagatgcaggttcaaatcccagctctgtcacttacgagctgcatgaatttagacaaatgtcaaattctctgagcctatttcatcatctgtaaaatggtgatcataactccttcagtacaggattattgggtgactatacaaaataatacgagaaagcacaaagcatttgtacatagaaagggcaaaatgaaaatcctccctacaagagagagaaaaaaaggcagatctaggctcaggagtagagacgctgctctcccatctttgggaactgcatttctggctttgctaaagatgaaggtcactgtactacaaagacaatcagattgggatcacccctgggaaatccataagaatcagattggaagagcactctttatgagcatcatattagattataaacctttttatagatcttatagtgacatgcccaatctgatttaaaataagcctctaaccctctattctcctactgtctctacctactactcccaacataatgtgataagcaaagcctaaacatttcaatcatgtacaatgtgaagttgcaccacagtaagggcactgaaatgacctcaggaagcccgcatagccagatgtctgcagtccttctgcaagatcccaatattttcaggttctacctgggtcagttcgctgctctggggtaaatatcaattagaggcttctagatcctttggctgttgggacttccagaacagcatcaatgacttcaaaaacatcctgaagtcgattaatctgctcctgttgtatgggctagattcctgattccagagaacaggccaacagaacgcaggccaagaggaccccacctttgcatttctatttctcatggcaaggttgcctcactcccagaaaaaagaactttagctttattatctgagacaggcagaggattgaagctgattgccattctctacatatctgattttatattatgattgtattgtggggcatgctactgcagagtttaactgcattgaaatcattatatcatttctctttggctataaagaattttaatttggggctgggcgtggtagctcacacatgtaatctcagcactttgggaggctgaggcaggcagatcacaaggtcaggagttcgagaccagcctggccaacatggtgaaaccccgtctctactaaaaatacaaaaacttaaccgggcatggtggcaggcacctgtagtcccagctactcgggaggctgaggcaggagaattgcttgaacccgggaggcaggggttgcagtgcgctgagatcatgccattgcactccagctctgggtgacagagcaagtttccatctcagaaaaaaaaaaaaagaattttaatttggaagccattcatagtggttgtagtttttgctcagaccatgttgtgacacacagtgtattggcttttcagatgacattaacccagccacctgctcatcttggtcctgctcagttaacctgcacatctgtatttttgtctttaaagtctttattatcaacctcactccccagctataaaagctgtttgtcccccaaacaagttgaaaagaaagtgcagaataatcagagtgtatctagaatgaataaaaaatgagaatcccatgacatccaagatgggatacagtcttgattggacatacagacagacatggtgacagaaaactcagaagccgggagggtcagagcgatggagcttactagaacacaagttcattttctcaaatgtgagtgttttgccctctctgattggcatgccttttttccttcctcaattgtggggcactgtcctctaaccacagatgacttctttacaccgcacggttgcagatagcacagtttcaaggagggtgtgcttggatctggtagaggtcatggacgaagtgaagacaaaagtgaagtcttggtggtactggttcacgcaaggaatcaaacagcccaatgagtcagagatctgctaagtatatggaagccttcatgacttaaaatatccaactgccacgagagaagttccagaacagaggagcctcttccagcatggacccagcagctacaggagggctcagattgcttgctctgccacgcctctgccatctgccccctgctgaagtcaggccagggaagaggtgctgcccatgagtcagccattctcaactgctgcttctgccttctcactttgccatatttgctccctatctgggatggtacagttccacagaccctgatacacctggggttcagcagacctaattagccttacatgtgtctgctcccaaaatagagagtcatttattccagtttctgtcctgatcagcaaggtgtgacctaggcccatggcccatagccccagactgggagaggagccacattccttctgaacagtttctaaaaaactttcagtcccaaatgagtgactttagaagtggagttttgaggatggagctgagcacgtggatttcacatcttctcctcttttcagtatagctctcaagccccctggatgcaaaggcaggaccctgatgaacttgccttttctatgacagtctttacactacaagaaaggggctgcaggacaatcccagctcccaaagacccagcccagagctcaggaaagccaggctgcttctcaccaaaactgaaaaccaggacaccttgggaacactcaggaccccactcaggcaccagctccttccggcagctcttccttaccctgctgaagtgctgaccatccctgcccttgactcactcccattgcagtgccaactcagagcatctatccccaaagccagagtttctgggattcagatcttggaggtgtcacccattccctatgtgactctgtgggagctacttagttaatctgcaccctaatgtcctcatccatcaaatgtcgatgatgacagcacccatctcacagacttgggtaaggctcagaagagctaatataaagaaaatgcttagaacgtggactagaatagtaagcactcaacatacttcccatgctgttgttggcgccgctgctcccacttgtcagataccatgtgagaccaggagccccttgaaggtgggaaactttttctgtttacttctatggtcccagcacccagcacagagcatggtgcagaaaaggctcaaaatgttttatgagtgaatgaataaagcgaatccagttggcaatgctggactatatacagcttgacttggtgatggttaccttacagactcctcccctgcaatgttctgaaagagggcagaatgtcaacgggcaggcacactggccagagagaaactgagcaatgtgagaatggccaggggagactgggcattacagcaaaaaagactggcattgaagctcaccaactgggttgtcttgagcacatccatttcctcttgggcttcagtctggccatctgtgtgtctaaacaaaggcaggaactactagaaagatggggtatcatttcagcaagaacaggtggagaggtgaaacatgactcatctttctccacctgccccaggggactcccc[450 bp omitted]ctctgagtaaacaatccaatgatgctacccacaaaggccgcagatccaagcttaggaggcatcttcccgtcaatgccctgggggcccctgttgccaagtgacatgtgtctgtgattgcagaaggccctattctcccagaatctaggggaggaagggggactttatgcagctggaaaaggcaaattctaacagtcctttgtgattttagacatggtatttaatctcttttgaaatgccaaataatattaaaagagggcatgctgcttttatgatttttcaggaagggtcatggactaataacaggttgcaaacattgcaacattgctgggagggttcttgcccttgctgtaggtacatattgctgttctatttataaccaacatgaaaacaatgtaataatcagaactaagagatgtatacatccctttagcctacctatttttcttggatctggaatattttgggcctcacttgttgatttttagcagcagttgaaaggagctgaccaaatgcacattaacgagacgacattcctgtctctttctgtcttcactgggagacgtcctatttgagccatcctggtttgagatcccagcctcccacccctcaagcatgagacagccacgagaaggccccctgcagccacaaacatttgtcagagtgatttggtgaagttcagcagtgaaagcaatttcttactcggaaaatcatttatcatggatagcctgtcgaaaacaatctcatttcaaacccttcccagggagaaaagaactgacaactggcactaagtaatctacaacagagccatgggagtcattcatctttcctttgcccagcccaggacttgatgctttcagaagagaagtggaatcaatcataactgctctgaggggcttcaggtaaaagaggagggggctaccgggacagccacatactcctgagtgcacaatgggagattgttcagtctctattttactaatagccaaaaaccagaagagtagttgtaggggtctttgagggaggtgtgcctccttcattacaaaacatgttctttttgtacttttagctcatcttaaatgccagaatcctccttcttagggagcaattaaggaaaagcttattgcttttttatataagctgacttcccctttgcctggggcagtcttttctttgccagaccatagcatggagcttgtggcatagtagataatgattctgtgcatgccatttccactgacatcaacaccctggaaacagaatatctagcaatttgaggctcatggagaaaagcagaagagggaaaatttttccccattaagttccctgcttttttaaaaatacaattagttacagataggaaaagcaattgatcactttccttactgaatgtctgattaaacccaggttctggttttgaggttcaccaagccccagaagaagctaatgaatttcagggctccatcattctcatgttttggcattaaccagtgactcagaaggtactgccagatgcaaattatgacatcaatgctatactccctgggaaccaaataaaacagaaccacctttgtagatgggtagctcccaccagttcccagaaatatttatattatggatattagtacttcattagtacttcattattataccaatcttaactcagaaataaatcaccaggtttagcacatatgatgctttaagataaaactgtcctcaaactgctttcatttctctgtcattatcaggggtctgaaatcctgactattttggaaagaagtgttatgctattttgcccaagccaaatgcaggcattaacggtaaagttctgggataaaatgctccatttgaactgaattgttcacataaaatggctaatttctattagccatttgggagtacttctgccacttcccagctgtcactttaagcaagatactttagcctctctgtgccttggtcttctcatctgtaagaagggggtaatactgctacctaccctgtaagatgttatgaggattaaatgaggtgatacttacaagggccacagcgcctgccaaaaagcaagcatttaatttaatttttttttttttttttgagacggagttttgttcttgtcgcccagactggagtgcagtggcgcaatcttggctcactggaacctccacctccagggttcaagtgattctcctgcttcagcctcctgagtagctgggattacaggcacgtgccaccacgcctggctaatttttatatttttcgtagagacggggtttcaccatgttggccaggctggtttcgaactcctgacctcaggtgatccacttgcctcggcctcccaaagtgctgggattacaggcgtgagccaccacacccggcctaatttaaaatatcttttagaaaactctcagccagagatgaattagggggtaagccaaccactcggtttcctggtagccaatctataaagtccccaggagatcactggaaaagtaacaagatggaaaaatgagattttcagggtgagcactcactatacatgatcgagaagagcactataaaaagccaggtgtgaggaggtaaagctcccataaggacaagatcagagataaacaaagagtctctgaactgctaaagaggcttgccagggtccctgagccacctctacaacagttttcttcctcctccgcttccccaacacaaaggttagtttctctgctaaataaatattgaatacttacataacaaatatcaatttgaaggcacataaaattatgagcctgcccaagtgtcttcttggcctaccatgctctgagctaactggggcactgagtgtaaacactctcccggctactgctttgctctttccctccctcattattcaccacattcagtgaacagaaattccagcttgagccacctgtagtcatgtggcattggtccaaagccctcactaccatgggcgccaaccctaaggggaggtatcctcagcactcactacgtgaaaacctactttgcttgggaccaagaaaagaataattcagcatgaatacgacatcactggaacttgttagtgttatttgaaagatgtggctgaagttttacatagggaatgtgtgcttccatcacaagtaacacagtgtatacaaaactaacaaagcagtttgtggccaagaggtttttgttttctaggatgaataagaagtccatgttcttgaaggaacttgaggaacaatgactacttcaagtccaccctgaaatatggacacgatggaaaagcaaaggtgggtcatccacctgggaatctctagttcaatggttagctcagtaaatcttcccaatttaccatgcagatccatctcccttaaccccataaactgggctaaagaataaacatattgcaatttgggtattaatttaatcaggcatgattttgcagagaagcccatggcaaaaaaaaaaaaaaaaaaaactttctataatgaggtccaataccaaaaatagtagtaacaataatttaaaagcagattgtttaaaatccatctcttcctctctgtttctatccataattgaggaggaagagcatttgttcagcctactgtctgccaggcatgtgccaggagcttcactcatctcttcaccccagtatattattgctgttgtatggatggagaaaccaagatttgcagagattatcacctgcccaaggctaccttcctgggaagagggagatctggatttgaaccccacctcggtctgagtccaaagcctgtgctcttcccacattgtgctgctggccatccctgaagctgccgctgtaggtggagcatactccctgagacgaaccaagggagtagtggctatatatatatatatatgtacacacacacaaagcaaacaaacaaaaacaaaataagttggcgaggatgtggacaaattgcaacccccgcatgttgttggtggaaatgtaaaatggtacagccattgtggaaaatagtttagtgattcatcaaaaagctaaacattgaattcctaaatgaccctgcaattccactcctatgcatataagaattgaaaacaggaattcaaacagatacttgtgcacaactgtttattggagcattattcacaatagccaaaaggtagaaacaatctacatgttcattgacaaatgaatggataaacaaaatgtgtggcagacataaaatggaatattattcagccatcaaagggaattaagtactgatacgtgctacaacgtggatgaaccttgaaagcattatgtcaatgaaggaagccagacacaaaggtcgcaaatatatgattccatttagatgaaacatctagaagaggtaaatccatagagacagaaagcagatcagtggttgtcagggcctaggaggacagaggaatggggagtgactctgatgagtatggggtttccttttgggtttacagaaatgtcttgactaaatagaagtgatggttgcataacattgtgaaggtacgaatcaccactgtatcgtacacattaaaatggctaatagttacttttatgctctgtgaattttgccaggattaagaaaacaaaagagtggtaaagttagaagatatttcacaagttctctattgcactgcattctttgtggatgaggaaaatgagctgtcagtctgtccagtgcggaattacatagctaaagtttgccggtgaagttggggttagaagtcaaccctctgtcaattaatttatcagagcttgcacccaggctcacactggggctctggaggaaaagaagaacaatattgagagaaataattctttctcaagtgtaactgagagcctcccagttcctgcctctttggctcaaagctcatattcctgggaagtcatcctcccttccactccagggaaaatggcttcctacttttatgtgaaaaggagccacaaagaattcagcatcatgaaacacccttagctctatcaatagagaaatttctgtcttcaagggaagtccacttgatttgcttctgcttgaagtgaagcagataacctcaatcaacatctgattacttctttaatttccagagcttgctcattaccgaagccacactgtctctagagaaggacctagagtaactcagattttaacacacctgggctgacaagttacttagcttgggctttaattgagaaatcagttattttacccattattttgctaacattatcaaaatcctgtgatactcaaggccctgaaatgacattttcctctcctttatcatttgtacatgtgactaggagaaaattatgtgtgatggacatgtcgaagatacataagttcttgaagagattctttcctacttgctctactcactgatccgtttccactgaacaaattgagtatcagcatgagaagtcacaaggcagggggttcattctttcttccctggcttggctttctaaagcgtgtgagttttatattgttgcttttcaagatgtgaagttgtgtgtaaatttgtgtgcatgtatgatgaatatttttccctgctaaaaggtacaatgaaattgatagtgaaactttgcaaaccaactctccgataagcttctagtgtttttcttttttttaggtttgccactaatcctcccagcatttctgcagattgtaactgaagctcagcttttctaggaggaaaatacctgttatggtcaacaacctaagagtcactcttgattcctctccattttcaactaaacagctgctctgtctgtgacgcctccagcatgtgctcacaccccaatggcctcggacctctcccaaggcagcatcctctcagttgagacctaagaaaactgcctcccaaatattttccttgcttttgtctttccctgaactctattctccacatcacagtcattatttgctaatggctttattgagttctagtttctacaccatacaattcacccatttgaggtttaaaattcaatgggacaatcaattttaaaacactttcatcacctcaaaaagaagccctgtagccttcagctatcaacccccaatctccccacaagcaaggagtcagtaatctattctctgactctatatatttgcctattcttgacattttacacaagtgaagtcatatactgtgtgatcttttgtgactagtttcttccacttagcataatgctttcaaggtacacatatgttgtggcatgtttcagttctccattcctttttatagccaaatggtattccactgcataagcacatcacattttgttaatccagtcatctgttgatgggcatttagattgtttcgctgttatgaatgttcaagcgcaagttttgtgtggacatgtattttcatttctgttgggtaaatacctaggagtggaatgtacatgtcatggtagctctgtctttcagtttttcaggaattgccaggctgttttccaaagctacagcaccattctacatcatccccacgagcagccacaagggttgcaatttatccatatccttgtcaacacttgttatgatctgtcttttcaagtatagccatccaaatgggtgtaaagtggtatctcaccatggttttgatttgcatttctctgatgactaaggtgttgaacatcttttcatgtgcttcttgactatttgtatatcttctttagagagagatgtattcataaactgaccatttttaaactgggctgtcatttcactttctttgtaatgtccttccattgaaacacaaatgtttttaattttgatgaggtccaatttatctactttttcttttgttgcttttgtgtttggtatcatatttaagaattcatggctaaatccaatgtcacaaaggtctaccccgtcttctctcctaaaagtttaaatgtttttgctctcacatgtagatctttgatctattttgagttaattgatgtgaagagtccaattttattattttgcatgtgcctatctagttatcccagcaccattttttttttttttttttgagacagggtctcactctgtcacccagactggagtgcagtggcacaatcacaactcactgcagcctccacctctcaggctcaagtgatcctctcatctcagcctctcaagtagctgggttcacaagcgtgtgccaccatacctggctaatgtttaaaaaagaaatttgtagagacagagtctcactatgttgcccacactggacagcatcattaattggaaaaactattctttcctcattaaatggtcttggtattattctcaaaaattagttgactataaaaactggatgtatttctggactctcaattctattccactgatctatatgtccagaatgactgtttaaaagtggaaattgcattattactctttctaaagtaatagcctaatgcccaatacaagtcattctctatcccaaggattcttcacttggggccatatacttccaagaggtccttgtgcagtactcagggagtccatgatttggaccaaaaaaattacatctttatttttattaacctctaattcaaatttggcatttcctttaattatgaatatagcaataaactgtagggagccaaaggcccatgggacatgaccaactcagcattccactggaggctatatgatcaaacagcaaactgtttatcgtgaatgcagaatgtgagcaaactcaggactgcgcatgcctccaggaggtttgctaagggccaggaggtttgctgggctccttaaagttatctactgggaaatctagtgcctattgtttgaagaatgcagtcttgcaagcctgctgtgattcaaactgctggccgacaaccacctgcccctttctcgttatctcttttacctaataaattcggaggaccgaaacagctcagggcccttgtccactagaggcgaggtgcccccaaccccttcttccaaatatactctcttgtctttgacttttattccccagttagccccactttgttcagtccaccagggatcatggcaggttacaagtggcaccccgaacagtgacagaatcaggtgttctacaataaattagaacagtattaatgacacttgtaactttttttagcaacagaaatctcagatatttacatataagattacaattgttacaggtatctcaaagtattacttatattaatcctactttaaaatgatggtggtatattagaattattgctggatcttcataaaaatgccctaatcaagaagcaagcagactttatcataatttgttttttataatctgataactgattttaacataatctattttcttataatccaatgtttttatattatgcctttataaataatatttttctgagaaaggggtcatagtcttcaccagactgccaaagaagtcctcagcacaaaacatttaagaaaccctgctttttccattaccagttttattttcttcccagcacatggcatcaactgaatttatcttatttacttgtcaacttgtttacggtctgtctctttctgatactggaatgtaagtgcttagggcttaaaatagtgtcaggcacataatagccattcaataaatatttattgagttaattacggaatcagcagcaattttctaaacaagagctaaatcattggcttaatgaaaataaagactactgataccaaattagtgacatgtaatccatactgaaaattattttacatttatgccatcatcatcattagatttaataaatgccagcatgtcctatgtgctgtattaagtgcttgatgcacagtatctcattcactattctccatactaacaaccaagaatatcattaaccatacttacagttaagggaactaagcctcagagaggttaatttctcactcaagttcacatagctaacaaatgacagagttgggatttgcaaccaagcctacctgccttcagagtattgatttttaactacaataaaacacttctaagagaggaggaattttcttcctgttcaactgagaaagctaagatcctgtgaagttaagaaatgtggcccagaacgcagagttcagcagagatttccaataaaatgttctttccactgttctccttatgagccacagcaggaaaaccccttagcagaactgggtgctatcaggttgcctcctacgagaagatgaattttggaagaagcataattaatactagcaggcattaactgaagcctgttcttttctttcctggggtccagtctgcttctctaaatattagggcttggcctcattcagggcattaaggacttcattaggctgaaatccaagttaatttgattgcacaattataaactgtccctggctggaggttgtctcatttgccaggttgcaagggggcagcatggctggatgacatgcttttgatccccagcttgaagtttcagtgctttctggctttgacctcatcaagttttacagaaaggaagttaaattggagcagggagacagatattctccttactaaagttgtcacgggcacacagaggaccattcatcaggtctgcaaagaaacaaggcacaggaaaagtcctggtcacccggaggtggcagcaaatgagatctaaccaaaggtccattatgcccaaggtcactcacccacatggcaagcatacatccaggctgacccctttcctctttcctgtgcctcattttccccttactggctaacaggttattcagcccgggtatgcagaggagccaagggaaggaataaatcgcttcgttttcaacagggattttgttgacattagtagaatctggaagcatccacttcatggagtagcattttcctctcctctgctattcatgcaagtgatcaaaggacccacttccagccttcctcaagagaggcctctcctccagccaacaaagtcccttcactgactatttttgtaaagacattaactttgcccaaagagaggcctggccttgtcctgagcttctgggaggcaatgtctaagcccttggagtgtcatgcctgataaaagtgtcttttccaggggtcttgggctggccagatagtaacagtgttattttgggtaggggctgaccatgccagaaagtctaacaatgtcatttatgatggaggctttgggttacatggtatccatccacctccaggggagcaggggactgaggctggccatgagggcagtcattcaagtttacatgatccagtcccagtaaaaactttgaactccgaggcccgggcgaactttctcgattgacagtactccttgcgtgtagtcacacattgatgctgggaggtaacacgatccatgactccacatggaggagataatgaaagcaccatatttggatctttcccagactctggcctatgtactttgtcctttggttgattttaatctgtatcttttccctgtaataaattgtaaccgtgagtataatagccttcagtgagctctgcagtcctatgcattatcgaacctgaaggtgacttggggaacgtgccaaacctgcagttgatgtcagagggaggatggtcttggggactgctcaccccatgcccctcttctgcagcatccaaattctacccatgccttgggacccaactctagcctgccatccttccttaaagttccctggattactgcaaccagcaagtatgctggcttctacactaaaagctagtgtttcttaaacgctttttagcaaattccacagtaagaaacagagtttacgtcacaaatcagtacatttatacagtatacatacgtttatacagtatatatacatttatacagtacatagatctatatatgtaatggaaacaaaagtttcataaaatcaaattgaacttctctagctatatttccatcttgggctgatcaatctcatgttttatttatttatgtatgtacttttagagacaaggtcccactctgtttcccaggctgatctcaaactcttggcctcaagccatactcttgactcagcctcctgagtagctgggattataggtaaaagccaccatgcccagctgtgtcatcttttttaaatgcttgtttttcctttcacaaaccatgaatgagttgagattgcagttttcagaagcacaggtctcgtccattattctgataaccgatctctttactgccttacaatacatcttattttgtttcttaacttcactgtgtttatatctcatctctctcaagacctgattaaaagtttcaaaacagacctcaaaaagaacaataccaataatatctaatactttttttggtcatgttcaagctgggcactgtactaagagcctttccatgcagtgtctaattgtttccacacactactatcaggtaggtattatccactatgacatctctcatcaccactttcaccccatgtgacaaaggaaagacttcatagcttggaaaggttaactggcttgcccaggacagctacaaagtagtagagccaagtaagccaagaaggtctggtctgattccaaaccctggtgttcaccactaggctccttcctccccactttctttttgcaaaattgtttttttaaagacagggtctcactctgtccctcaggctggaacacagtggtgcaaccagggctcacttctgcctcaaactcctgtgctgaagccatgctcccacctcaggctcttgagtagctgagactataggcacataccaccatgaccagctaatctttaaaacattttccagggcctcactacattgcccaggctggtcttgaactcctgggctcaagtgatcctcttacctcatgtgagccaccctgcccagctacattcccacccattttcattccccgccagagctgcccagcagacctttttgccccagagtggaaagggcacagatgacaaatatgaatatacaattctggcccagtgggctcaaagaggagggagttggcaatgtttcctcttcagccagcattcttttcaagcaaagctctgtgaccttctacccgaaggcagcgctctcaggcctgtctgttgcggttcccctcactcatctcaggagagtctccttccagaatgccaggcacccctgcctgcctccccactgcctcgccttccctgcaccaattaaactgtcacagtcggctggcttggaggcaggtgaggtcaggaagaaatctgaaggaagctgggaattcagatgagatgaggcctccttgtgctgaagctcctcttctgttttctgtcaaactggtctgaagactgattggatgagcccatagagatccctggcgactctctacactcacctcttcctctccaatggagggtgagaaatacggccttgtacagaagtggcagcttttgcatctgtttgggtacccagtggtccctagttcctggtgcaacagcagtgggtctcgggtggaatgattttggctggagattgtttgcatcctggaatcattgcctaaagaggaatttgtcctctacaaacaagtgctaacccacaatacacaagagaagcaaatcaaagagctcttaggcttggcctaatagatgcatcttgtcttacctaccccttttagtgttgtctgttattggaggaagaggtaggaagcccagggcctccctcccagagtttccttagcatcacctgtcattgttgagattttgaatgcattgcaggttaagggacacttgatcaagaagggaaaacacagcagagactttcacttagacatgttttgtatgtcatgcagggaaaagttcccagtcaacctctgcttaaccttcgggtttgaagatggccctctggcagtcacctgatcttcatggcagaagaaacaggagtgaatgagcagatgaatccatcttaagagaatagaaatccttagtttgggtttcattgaccaactatagggtacctggcaggcaaaatttttgcagctttcatccaattcccaaatgggtgtttgacccacaaaagaaccaccaccagtctacatggtaatatacatacattgccttctataattttacttgctgtagctgccaaatcttattcatacttcctccaagcataagcacatgcatgcacacagacacagccgccaaatgcaccctccttgtctactcctcagcctcacctcgtacctgataacagattgtactcaaaggcactggaagaccacatggctgcctggagcacctttcaattattaatgctgttctttaaaggccttgccttattatttctactcatgctattatgaagagggcaaactccttaatgcactcctgtgccacttcctcccactgctagaggaaaagcacatgctaggtacagtcatctaatagcatccacgttattttcaccttctctgcacactgtccctgcagttctctctggggcctcaagatcaattgtatctcaaactgggccatgggttcattttctgcattttctggcatggagtgagggtagcgggtgtatggaaattccagctctcaaattacaaggtggcaggtctctgcatgggtgtgatgagcaacatgagataggtatccttgttaaggacaactgcattctagtagattccaccatcagaggtcctggagccctacctactatttcttcctgagagtgtcctgataggtaaaaggtggtgtgagtgtcttccacggggaaaagagactgatgaggcagctctactgaaatggcagttgatattaatagggccatctacttcctactttgaaaatatctgagctataagctcagacgctacctatcactaactgccaaatttccatgaaaaagggtcagtgatgaagttgtagcctagacttgggaccatgtctcaggggaaaagtctaagtatgcctccgattttgttttggaagggacgacaccgtaagaatttcatcagtaaatattaaatacaaagttcagcaaattgtgaactttagggttcatgaaaactaaagccaggatttatccatgtcaacctgtaccttatacctacatatgctagaaactaaatcaagtttcatacaatgtgcccatttagctaagtaagtcagaggatagtttccaataattactaacacttacacacttagtataatcaactcttctttggtcaagttaatatcctggcagaacagacagatttgggcctctcttcttataaaaaaagaatctgacaatttaaggggcatatgttcacttccatttatgtcctggaaaatatgccctgtgacttagcaaccatgttttaaaagctcttgcagttcttaaacaaacagagtgtatgtttatgagcttctaacaacgttattttcagagatgatgtagagttagtgatatgtagctctggggcttacagtaagctgtagatgatttattggtgtggcatacagtatttgcctcgagaaaaatggaaatttaagcagtgtttgaaaatgtgttagatggcaaacgacccggggcaccctgagaccaaaggcttcccatcttagagagagaaggggtcctttttggcagatggaggagcaagggttaagaacgtttcctggcactcagggagcacagccaattcaagaccagaaagagagacagtttagaatagaggctgaaaacaggaggcccaaatctggcctgcagaggtgttttgcttggcctgcaagtactttaagagttttggatttgaggccaatattttaaaattggagattcaacataaaatgcagtattctgtctcctctttgaaacacaggaagatctggccactagagcctgcatttctgcataggaacaatcagctggacctgggaagccacttcaggtgaggcttcagctctcattgcagtcctcaccagatccgcctcactcatttccaatgtctgcccttccctgtccagatgaatttgcaaacatcagatgaaaaaaatgttattttgtactgttgcactctcagcgaacagatctcttaaaccagtaagactcattgtcagataaaagaatggaaaaggcacatgtttttccaaaactcgggagaaaagcaagactattaagttgtcttaaaatttttgttgtatccattgttttgaatgctgggttgctgaagttcctatttcccaaagccaagttatcagacagggcttaaaataaaatgcttattttaattttctcatttgaaacaattagaccacattgaaggggtttagtataaggcatctgtctctgagcatgttttcttatctgtgaaaatttccagaaggatggggctgttggaaagggagaaataaagtcaatttctccagcaggcagtgcaggcacagtgcctgaggccactgtacttatgggacacaaaaaagtctaaattttaacttctttaaaatcagaagaaaataaatataataataaatgacgaataataacaacgaatccaggctgggcacagtggctcacgcctgcaatgccaacactttgggaagctgaggtgggaggactgctagagcacaggagcttaaaaccagtctgggcaacacagtgagacccccccatctctacaataattttttttaattagctgggcatgatggtgcccagctgtagtcccagctactcggaaagctaaggcaggaagattacttgagccctggaggcagaggttgttgtgagccatgattgcaccactgcactccagtctgggaaacagagtgagaccctgtctcaaagaaaaaaaaaaaatttgccagccatggtggtgcattcctgtaatcccaactactcaggagactgagactgaaggatcacttgagccaaagaggtcaaggttacagtgagctatgatcatgtcagtacacttcagcctgggtgacagagtgagaccgtgtctctaaaaataatagtaataataacaacaataataaatccagcctggattatattcattcttataccaatgcagccgcaaaatataatatttaatattcttatggaagaattggctcaacaaagccaacgtacctagagtccatggaaatcacagcacggagctggaggcaaatgctggtcttcaggccaacaaccatgcccacactgtggcctgtttgcgagcagcacaagctcattttactgcagactctcctccccatcatgcccctgtgatgctctgtatgtggcaagttcgtaacaagacccctgcaaagcacgtcgcacactgacctcagtttcaaaaagatggagtggatgccattcagatgcttctggaaatttccaaataaaaatttccaaaagttttaatcatctatcattggacaacaggtattactgccactggatagagtccgcttctctgattattttatgccgtccctgaagcattctcaatccctaatctcagtagctgatttcaaggcaaggttttgcttgactttagcgtatactgaaaatcacaaagcccgagtacaggccataatgagagtcttctcttgtggactcctagagttgagggcagactgagttttctgtctattcaactcaaaatctcccctacagccaaaacatgttatagcatccagctatcttttcaactcctcaaccttcagcacttactgtgtgcaatgctcatattagtcattgatatattgcttagcgatgccttacttgttcttgttttgttatcttatttttcctttatatatggctggacttcctgccccttgtaaaaatatgtataatttaaatgtcttaatggaaaagatctagcattatacataagtactcaaaattccccagtacctagcaaaatgccttatacacagtttgtactcagtggagagctattatctgattggtacctttaaggccacaggtacacagacagctctcagcctcatctctgctactgtgatgagcctggtggccaattcccccatgctcttcttctccacttaatttttaggcaggacataattgtttcctacacacacacacacacacacacacacacacacacacacacagagtctttctctccctctctctcttttctcccaaattctatgaacaaagacatatgcatcaaaaagtcccaagggcattgttgctttgagagttctatttttaagccacaaatgactcatcaccaaccagggtctccccaaagctacatgtgtcaggctgtcaggtcaaaagacaaggggtaaaagacaaggaagagttcacatctcctccagcccatgaaccccatgataaagctgtaaaagctgccaccactccacacaccacaccacacccctaccacagttgtgttaggcacaagcactgcccttgtgtttggattaaactgttctgagctataacatttcgctccagctggctcctatcctgatctctcagcagtctctgaatgcatgtcagcctgtgactatagggaaaggcccagtgccatgtgacagggaggagatgcagccctcttgcggtataaactcaggcttgttgtagaggacagaagtaactagtgggctagtgggtctgaaagggaatgcatttcttcatttgccctgaaacaattattcttttaaaaagaataagagagggctgagagagtgccaggttgtccaaagcattctttttaagttttggagagtggcgagaagggaagaaataattcatcctaattttggaaggcaaagtagatagggatgtatagacatagttatcagatagtgtttccacaggggaaacaagtgagcaattgggcaaaatgtcctcaaaagttatgcataacaaattccaaacaggccaaaacaatgtgttcagctcttcaatgcgttcagccctgtgttacccttccacagtggagctgaactcttaactcttacccatccccaactccatgctgaaacagtacaaaaaagagagggagacagtggggagggagagagagagattagtaggagggtcataaaatcaaggaattcaaggcctctcaccagtgaggatgaaataaactaatcccacgcagccacctggctggatttgatcttttccacctgggattatctttgttctttcccatggccctaaagtttcccccatgataagggcctagaagtccagaattggcataaaaagacaatatatactttgctattcaatgagtaggttatcatgtctttgttcatttctgtatttagtagaaagaacccaggagatcaagtagaaaaggactgggagagaaaagttctatcttccagctccagctctgcccctggctggtcggatgaccttgaggaggtccctcatcctcattcctcaggaaaggatgctgaggctcagagaacagtggcaccagttgggatccaatgcctctttgactctaatactatattctacagttgtcttttgtggcagacctgaaaggttcagctcagtcctcctgtcctttcctagcatagtccctgatttccccaatgaaagccaaagataagcagttcccttaatgcttctagatgccattgcctacgatgcctaggtaccacttgtgcaatgacaaataagcaaggaagacaagatttcctcaccaatgtggaagggagaaggaggaagggtgctaatgctctgaactttgacgtaaatgaaaccaatctgtttgacaaccaaagaacagatcctgtccccaaaatctacctatatggagacaaggacatataaagaagttgactctgttccttggcatactctccacctgtcttctctaccaggctttcactcgattcctgaacaaatggcaatatggaaggtcagatgagctaggaaggctgagttagagttactctcatatcagagcaccaagtgttgctattaaagggtacattctgaagggagacaagacttcccattggagttatttacagcctctttgccctgaaggcatcttctcttccaccatccctgagtgggctcggctcctctaccatctgacattccattctttcaacagctgctggctctcctgttgtgttcccttcacagatgtgcagtgccgttctgaacatcctgcccttgaactttccctacccataattttccaaaccaaagcctggcaataaaaatgtcagtgagggatggagaaaactggggggagtattttaaaaggaaaaaaaaaaacagggaggtgctttgcacacagtgatttgtgttgacttcttcaacaaaggttaaatgcatgccgtgacttctcaaaaaagggcatgaaggcagacagctggagctaattttccagaacactacctagaaaggctgtatttcataaaggaactggttacagagtaggctggtgagcttccttttccatgtcacaggctgcccatctcatcatgctgcaggatggggtacactaaaggggatagtgaaagctggtatacacagtcctttacagtttaaaatgcgctgtcatgaatgggatgggatctgtgctgtcctcacagctctcccaggtgcctgtcttggggctgagcacaggagaggcagtgggtctacacctgtgcctagtcagtttgaacaaggctggagaaggaagccagatactttatgacatttcaaagacctccatcctatgtggctccattctttggggccaaattttcctgaagtccattagtttgataataccaactctctgggcatataaacattgcataacataatgcaaaactataacaaatcaactaattctgtaactctctaaaagagataaaagaatgtatctcatggggaaacagcatttctcatatctatttcagtatgccaaatcacaaggacagattaggtaaggataggaaggccaaagagtctttctacttggaaagacacccctaggtggtggaagctaatgaggaacaatcagctctccttgttttttgttcatttgatcctatctcattgcaaaatgctgccactccactgagataacagagaagctggtctcatcaagccattattaggaagaactgaatcaaggcccaaacagacatcagacagcacctgacccagggcagtgtcttacatggaaggcctgtgataggagcctcctacgtacccacaactgcacacttggttctcagggtgagaaatggagaaagggagaacaaaagagaaaacaagaccagtgcattggcaggatgaggtgatgcaacttcccattcttgcaacatctcattaaaccccatcagttacttacacaatctggaaatttacttcttgacacttagaagagagatggctttagaatgagccatgctggaatctaatcctggctctactgcttactagctacatagcttgggctatgcctgcagcttcagcctcctcatctgtaagtgggaatagtaatacctatcctaagaagttgttaggggaattcaatgaggttgcatgtgctatttttggtaaagtgcctagctctgtagctcacagacagtacataatcagtgaatgttagttccctccaacgacttgccctctcttcccttttgaaacagaatttctaggccaagggatgagagaccaggctatgtgaagacaggggagggagaaactactgggcaactaaaccagttctgctaaagctctggacatccccaatacatcaatggtgccagttttattttcagagactatgaaaacaatctggtcaatttctatcgcaatcttaaagatagttttccttaaccataagcaattttactgcctggaaaatattcagcattatcacatttgaagatgttacaaactaataaatgaatacaaaatgaataaatgggtgagtggatgcaaaagtaacattttaaaagactggggagaggccattttccaatcgtaaccccactgttgccttggcaattgtgcccttggatgagatgctctacaaaatttgtgctgccatttcctgctccttcctaacgtccatatccccaaaacagcagtgctgataccagaagccaagagcaaagactggcaaaatcagcaagtgcccccattgtgtgccagccattttggagcagataaagtcattaaggaaacatttaacaacgtataacctttcagctttactctgcaaacagcaggtagcttccctttcagagacaagagcctgcattgaagtcaccagtgagcaggacttgaccttcattttcagtatacgccacattaaatattcataatccgcgtaaccgtagcataagaagtagcagcgtttaaacatgaatcaaaggaataaatatcttcacacatgtgagtcatcctttcccagaatgcccctggtgaaaatgcaaatacccagagctctgggcctctgtctcttccaactttctcttgaaattctgaaagctacagggactgctgcattatgcaatccatgaatctcgctctcatgctgacactggtgggtctttgttttttttccttatctgttagataagaattgctgttcttgtgtcaaagggaggaaatagacaaggatggaagcagcaatggtgacattagcacccacagggcgtctgcaggcactcttgacttggttgtacaatttctaaaaaatctttgcttcacaaggatcagaatatgtgggaggacagggttggcgttggtgtcgggagacatcagaattaggaactaaagtgacgtgtgacataaattgggcaggagtccttttaaaaagaatgcaaaagaaagggagctttttgtacacaatccacctcgtgtggctaattggagatctttggggagatggtgtgtggagggctcaatgcttgtctgtgcttgttaaggcactaacatgatgtctgaccaaagactcagtccagaggcatcttcctctgcttgggtgtttctagagagtctactgctgggatgataaagcataattttagtaaggtttaacgtaattatctttggttttcaattccaggagctctgaggacaatctgtcttagccagatagtaatcacttgcagctacacaaatgagtcttccctcacaaccaccctaggttcattaagatcagacccaaagaaaacgccctatgctgggatctgtctttgcctaatggccaaaaatgaaaggtgtgcagctgtctttggaagtgacttatccatcacctctggatagtaaaaagagctttaaaaggttaaaaagatcataaaccaccaatgatgacctttctctgagctgtattgctaatggacagaagtaaaataactacctagcctgcttgtccacttgcacaactggagctggcctgcctcgagacatagctggtccagcagacctagggagcctgttttatacattaatcggcattccttgcacttttcaaagggctgggtgcagagagcctggaatctcaaacttgtgctacaggatagtcctcagcattctggaggggaggggcagctctggctaaaattcactgagacaagccatttcacgcatgtctgttggtttagattcacttgtgggaaagcctatagactgtcccctgattcatttatttgaagggtgtaaatactagctacaattcatctggagaattctgggtgctttttttccagggtgatgatttagtataacttccacgagaagtttaaagctgtctttccaaaatacccagatggccagccaaaccatgaatgtgtaaaactggtaacagttttgaatgaaagacatggattttaagaatgtacattctactttctcactttctttccatttgcatcttatatgtggatagaacttcatttttttttctcattcactaagctcgattataattttttaataggtttcactgtgttttattcctggaaatctatggacttaccatagagatggctttagagattctacactaattctctcccaaactaaaactgagcttgcttgccgtctttcccaaggaagatggaaaactcccttgtgctgaatccactgattgggcctgccaccggacagaatcttcggatatgctctcagaacaaaatgaagtcatgaaaatgaaaagtttctatataaataaccagaaggtcttcttataaacaaagccttgctatgccaaatcacacagtttagcaacagagaagaaaggctaaagctgggatgaggctacgacagtcctcaggcagaatgggaatagccttgtttctaaccttatgggcatttttgccaggaaaaggtgaggacaggactgaagttccatccttgggatagactatttgcaagttcataaaagaaaccagaatcagagaggactcccagtgccatcttcgccaaggcctagaaggatcacaattaaagccaaaggacattgagatggtgtaggacattaggggaagagggtgcattggggaatttcattccttttcatcttctcacacggaaacagagaacaccaggatctacagaacaaaagactgcctcatagtagactgtaaaaaaagacacaatccaaatccatctaaagagcattttatttctgagaaatacagagggacaaaaggttaaaaaaataaaaaaaataaaaaaacgaaaagggaaggaaggtgctggctgaggcatctggacttctaacccatcaacacactcacctccacattagggttttctttctctgggacatacaagcttcaagcccaaacctctttcctgagtctcagcatggaagttggcagggtctgcaccccacgacatgtaagaacacccctggagagagattggagaaataagaccaggggctttagaggatcttcagttcaatacaaataggatccagaatcattaacagtaaatatttaaaagggggcttaccttcaatgacatgccaatgggagtcttccaaacttaaacaagctcttctctttcttggctcgggagagctgatggagggagcatgtggaatcttgtctcctgacagcgtttaaaggactctccatctgagatgggtgagggcagcccagcctcgcatgtggggtgggctgaaggacctctgataggcttaaacttggctgattcccagagacaggttattaaaggagatatttgctttgttttccctgactgacattttggcctctccacccaaatgcacaaaatccttggccggtgaccagatggctctgagaaattctgagtttagctgtgcatgaaattaccaccatcccaagccacaggaaaggagcactaagctcagaattcaggcacaccagagtctgagccaacaggcacaccaagcaggtttcctagtatcaaagtctagtagccaaccatgccagggatagagtttaaagttcaaaacactcacacagtggacaataaaggcaacaagctcaaggccattgtcaccagagttgccaagttcacgccacaacagaaaatgagttagactccagcttgtttcccagatgccatcaacttcatgatttgcaatagtatagttggaacaaattatttcctcagggttggcacctgcaggaatcagggcagaactggctgcaacattgcagttctagtctgtgccctcttcatccttctgcaaggtctttatcatctgtcacccaggctcactctggagcaccagtccattcggctggcacccaaggagtctgcatgagtgtccactctagaagtcctcaaatggccagggcctccacctctgggggtcatgatgaactcctccatccatctccttaccttcacaagtcaagaagcaccagcgtgcaatgcttcagctgaatacccgattggcaggtgaaaggatagcatcatgctttctaatctgacctccagtaagatcaaagcattggaaacccaattgagaaaaggatcctacaaccatagcaagaatggctcagaccctcatctgtgggaaactgtcaccctcccagaagttgcaaattcccatcaagtcatcttaactacttgacatcttcagtgcaaatacatcattaggaaacagctctttaaaaataagtaatacccagcaagaagacttgacctcatatacctcaccctcctatgccagcagactcaaaatagccttccttctgagaactttctttcccatttagaaaatcagtacagtacagcactagcttcctccaaaatcttctgcactcagaaggtcttgcaaaggttggtgtcaaggtaaataaatggatcaatgtaaaggctcatgattgtttatgaaacgagggcaagaaagtatatttgaatactcactttgatgaatctatgaagtatattacaagtgcaccgatgctgagagcaaagactaagacaacctgtaaaagaagaggagaatgccatcacttaagagttggacctcaggatgtttgggttttttgacacataccgaagcagctttgaaatacggtgcccattgcccttggggacctgcttggaaatctcaccctcatccccagccccccattactgcttcaggtttggctcttcatacagcaatgggcagcaacctcgctccttgccaataggggtcagggtagccttttatgtctcagggcactgggtttttatctgaccctgttatctcgaagtccagcttctctgcaattgtagttgataaacttcagtgggaaaaaagcaggtgaaaatttagggtgatacaatttttaatattatatgtagtctaggatctgcaggaactccaatagaggaatatcaactttaacagcttcattgaggcataatttacataccacaatattcacccatttaaaaagtacaattcatcaatgactttagtaaatctactaagttatgcaatcatcactgtaatccagtttcagaacattttcatcatcccagtaagatccctcatgcctgttaaatcaatcccctttcccatttccaagccccagaccacactaatctactttctgtcactacataagagataccaatttgaagatcacaaatttgctcgtacaaatgtccgtgtgtgtatgtgtggacatacataaagatatattcactgcatgtatgatctatatgattagaacacttctgaaatatttaggaaagtagttccagttcaggaagtcaattaggcaatccattaggccagttatgtgacaatccttgtcctactttacactcttcactcaaaattaatctccatggatggaagacagttttggcatctccttcagtggatacctgtcatgctaaggtccatagaatgaatatgtagcagattaggctgacactgacacttctgtcctcagtacacattctactttctttaatctttcacagaggagactattaatgcaaataaaggatagtcagaaataaagaagatgctttcagccaacaattaagcctgagaataaaaagtaagcaccaccattacacacaatgcctggctgctaggtcaacctttccaggtatgctaataccctgaagagactgcaggctgaagggcattggaagtcagtctcctcagtgtccatctattgacatctctcaggccttggctggtgggtagagaggaatcccaatttatgtaaagactaagcatgatcaagctttgtgtgtgtgtgtgtgtgtgtgtgtgtgtgtgcgggcacgtgtgcctgtgtatgtatgagagacagaatctctctcttttacacccacccacacacacacacactcctgtattttttatgtgtgccaaagtggctgacagaaaatgaaatctgcatgagatactcatttaaagcattgcaaaactgcatggagctcctggggcagaatggtggcttgcacagcccagaaaatgaccattaaaaacaattggacactgtaaaaggaatatgcagtttcatagcaactgataaaatctccatataaagggaggtgctaaaacaatacaccactgaggtttatttcattctgccatttaaaaaaaaaaacaactaaaacatgctccaattgaatgctgcagtctatcagtaattatcacccgcccagcactaatccctcttagctgcctcacctcaacccctcccatcacacatattcattcatatgttcctttcaaaggtacacacaaaaacaagcaaacaaaaacatgagcaggccttcgctttttcctctattatctaaaggaggcagcaaaacaaaaagcttaagattaattttgatctgtgctgctatttctgaggcataagcagttagatcctggccctgacctcattctcaaaaagctgcaaagagaaggggtgtggccagaacccaggagaagggcctcttctccattcataaacagctgatttaagactaatccctgtccatttggctccctgtgtgtgtatctgtgaatgctgagcatctgtcagagctggctatataggcctatgccacccaaagccactgttgcagaaaaggactggaaagaagcccttgcaaatggcatctacatcattctgtaaggaactcaaaatctaagacccctgcaatggcaatgatttcgcagcatccagatggccaatgtagctgatcctaatttgctccagctgcctccacttggagtcagtgatggggactaatgcattccttatttaagcaaatcagccagtgacaggaggaggccaggaatcctgctaccctctgaagatgaaaactcaaatatcagcatctctctgatagggtaagagagggaagaaatccaggagggaaataacctccacagctccctggccctgaagactctgttgaatggacatgcatttgggtccacgtattcagctggaaggcctcctctcaatgagatacaggataggcaaactgccccatgatgtacgatgaaatgctccctggggagatgatctgcctctcagtattaaggtaactgtgcacgtagtcttgaaacttgctaaatgcctctttatcgtgtcaggcttgatcacattgtcagcccagatccaggtgctgcagaaaacacatcaatactttggatgtggccatgaaaatagaatccccatcagagacttgtcttctctaggcccctagcaaagccaccttagaagtgtcagtttagtctctctctttctctatctctctaacaaatccccattgtctgagaactctaagtttgaaaacacaaaatgattacattttagtctgcatggtaatggtattattatagagcaccccaaatagtcacctaagtatttaacatatcctatacataaggcccaagaaaaacagaagatgggaggccacttggagtcatgaaatatactcttttttttttttttttagacagatcctcgttctgtcgcccaggctggagtgcagtggcgcgatctcagttcactgcaacctctgcctcccaggttcaagcaattatcttgcctcagcctcccaagtagctgggactacaggtgcctgccaccatacccggctaattttttgtatttttagtagagagggggtttcaccatgttggccaggctggtctcaaactcctgacctcaagtgaaccacctggctcagcctccccaagtgttgggattacaggcatgagccactgcacctggcaaaatatactcttttttatagagtcattcttctgtagattaatcccatgctattatgcaattagtgataaatcatatagtacaggtttagccaatataaaatgaactattgcctagatggatcattagtaactgggtaaagatagaaaaagtagggcccttatctcaatatcctctcctttcccaaaatgtccttcctttctacatagtaccactactctaatatctcttcacgaagggctgaggccattgggaatccttttgcaagcttctatagtttcagggacaaggaggacagaagcccaagggacatggtaaaatgaggccaaggaaagcacagtaccccagaaagcaaagcatccctgccctacagcagctgagtcatagaataagacaataaccaagcatgtaacaaagcattgtcccacacaagggcttgggggcagcagtgtgatacacagataatttgagcattgcctcttagggcacttctgctagcttgcttgagagcctgtcctggttgctaaacttgccatagtctgagctcaacaaattacctcagccatcttggacagtatgaattgtcaccttctcagatttactgaaaacacccatatactgtgtggagatattgagtactcggtgtgccagattcctaaaaacaaaagcaatttgataaatgtcattggaacaatggtgtttgagtcatctattttcaaaactccaagatcaaacaagacatgtgtttgcacaaaagaatgccaggaacacacatacacggtgtatttttttttaagggcagggtgcagtggctcatgcctgtaatcccagcactttgggaggccatgacaggtggatcacttgaggccaggagttctagaccagcctgtccaacacagtgaaaccctggctctaccaaaaaatgcaaaaattagcagttgtggtggtgcacacctgtagtcccagctacttgggaagttgaaacaggagaatcacttgaaccctggaggcagaggttgcagtgagccaagagtatgccactacactccagcctggacaacgaagtgagactctgtctccaaaaaaagcaaaataaaaaaatataaaagtgggctgggcatggtggctcacacctgtaatcccagcactttgggaggccgaggtggggggatcacgaggtcaggagttcgagaccagcctggccaatatggtgaaaccctgtctctactaaaaatataaaaagttagccaggcatggtggcgctcacctgtattcccagctactcaggaggatgaggcagaagaatctcttgaacttgggaggcagaggttgcagttagccgagatggtgccattgcactccagcctgggcaacagagtgagactccatctcaaaaaaaaaaaaaaaaaaatctgtccctaacacctgatgcaaagaaggagcctggtgcaaaatggggaggagagaggggaagtccatagccatctcgctagatgaaaatcccggtggaccatgaagatctttcaaatgtctgacaaggttcatgaaagttcatgaaaatggacaatagcacagccaagcatagactattccccctcaggtgatggagcacttcaggaaaaaggcagattcagtgatgtgagtatagaggtgattgagttgggaaagctggctcttagaaatatttcctgttctagaacctggactggagttgctgcaattaggcccatatgctttcagcgggtgtgtgaggcttcacggccttgggaggcagattcagagccaaggctcacaaaggtggctaccaccagaatccagtcacctgaggagctttccttccaaagcagagatgccctcatcccaccctagggccagcaaatcatgagctgggggaggggaagtctgggcacctctttttaacaagctcctccagtgaatctgacaatgggagtcactgaattaaagccattaggagaaaccacttagctcaagtcagagattaatctacaaatgtcgccttaacaattagcccattagaacatatgtatgaggcctgcaggcttagagaatcgtgctaggagtactagaaaaagtacagagaggaggatgaattaattctctcctgagcaggttttacacattcttctcagctcacagcagaacaaatgaccctaattaatgattctgcatgtttgatcagggtttatctgcctactgaaggcagagacccttctcagaaaatggacaattttctatatatgatcccaaaggcataggactttttaaattgaagtatataatttacatataataaaatccactatattaaaaaatacactttgggaggccaaggcaggaagattgcttgagctcaggagttcgagaccagcctgggcaacatagagagaccatatctctacaaaaaaaactttaaaaaaattatccaggcatgatagcatgtgcctataatcccagctactccagagggtgagtcaggaggatcgcttgagcctgggaggtggaagctgcagttgagctgtgatcaaaccactacactccaacgtgggtgacaaggcaagaccctgtctcacacacacaaaaaagaaaaaaatagatgtgagaactcccaaggcaaaacaatctggtgacattttgttttttgagagataatatcattccaacatctaaattataatgtttttgtcctggtgaatttattaataacaatgccaacaaacatttattgaacacctatgcacaagggccagagtgagagacagagaaatgcaaaactgaaacagttaagtctggcctggcctttgccctcagggagcatgggatctagaagtttaaattactcaagagtcccttctgaatgtaagaagcgctacacatatcaacagtcatctccaggatataaaggaaggatcagatcaggcagagaagcaacaccaccctcatttcagactcccaaagtggaacggggagagaaagtgagaaatggaaaaccaaggaaaaaggaagaagaatttttgacattccaagtccacctggctgttctaggaaaggacagacaccagtgatatggtttggctgtgtccccacccaaatcttatcttgaactgtcgctctcacaattcccacgtgttgtgggagggacctggtgggaggtaattgaatcatgggggcgggtctttcccatgctgttcctgtgatagtgaataagtctcacaagatcagatggttttataaaggggagtttccctgcacaagctctctctcttccctgccaacatgtaagatgtgacttgctcctccttgccttccgccatgattgttaggcctccccagccacgtggaactgtgagtccattaaacctctttttctttataaattacacagtattgggtatgtctttatcagcagtgtgaaaacggactaatataaccaggcacacaggatgagtgatgtggagaaggaagagcacaggacacagaagacctgggtgtgaatctccactctgcccctataagcaacatgctcttaagcacgtcacctaatctctctgggtctaagtttcccaatctgtgaaataatgagattgaaacagatgattatgagatgggaccttggtaggaactaaaaacttttggcttgaaaaggtagccctcacttatgctaactgtaaaccatgtatacataagtctgattcaacatgctgacaatatgcctgtccctaaatctgtatgcaggagacttgtttcataagatcacaagaataaactccatagacactcagattcatagtttgtgtttccagcagcacaatcaattgctcatgcagaatgtcatcccacaaaactaacacaagacatagaagggccatggatcagctttctcctgagtctgggtctcagctctgccatcactacagaaaattgagtggtggtctgacccatcgcctccctctccttgcctctgtgagctttgaaaagcccatgtttttgcaggctttagccttccagaagctcagactgagtctcagtgttttcctaagggaaaaagaaaatgatttttttctctttactgtttagcaagtatagttgatatgttcttgtcattcctaagtcatgaatggttctcaatagaagaagatataggccaggtgcggtggctcatgcctataatcccaacactttgggaggctgaggcgggtggattacttgagatcaggagctcaagaccagcctggccaatacggtgaaaccccatctctactaaaaatacagaaattagctgggtgtggtggcacacacctgtaatcccagctactcaggaggctgaggcaggagaattgcttgaacccaggaaacggaggtttcagcaagccgagataacgccactgcactgcagcctgggcaacagagcgagactctgtctcaaaaaaatatatatataatatataatcttgccaccaaaaaaggatttttgttatcatacatttaaaaatatctgtaatatttctgcagagccatttaatcatccataggtcccctaaattaccaagctagcactatgaaacatcacatttgacttatggaagcacatgcacaaaaatgctgtaaattgattcactggaaaccaagactccaaacaacggattaagtagagatgtattcaagatgaaagaaaggaagaagaaagaggggctttgtagttggtatttgggattatagcattaaaataaaatgcatgggattgccagataagagtaaaactgatttgttcacatgtaaggaaacctagtaaaaatctctatgattttacaggcattaggatctggtgcttccaaaagtgcaatactatgaagccatactctgtgtgcaatggactgaattcttaggacacacatgtaaatcggagagaatccctccttaaatcacctcaaatgtcctccataacttttggtatgaagaaaaaaaaaatccttgacagagtccacaaggccctgaaagctctggtcttttcctcctctctggctttatttcacatgcttccacatctagactccaggaatctaacttgcagttattctcattctccatttgcctcctcccaccccaaccaccacagagccttcgcacaagcactttcctcctcccagaagcctcacctgctcacatgggatgcccatccttcagaaatcagctctgctgtcacttccctgcccacaggtattctgttttgtgtagcagttagcaaagcagcaattttacatgtctttgtgcaatcattttgatcaattgctctcctctttcctttgctggatggcaagttctatgaaggccgggtgtgtgtccatttttagttatcacgaaattccaagaaagtagcaaagtgtctcaatcagtatttgttaaataaataaatatgtggagaaaaggctggagaattagtttgaagactgagtgtagtggaagcaaaagagaggtgggagaaacatggattaccctcactgagtgagaccctgaagtttataacccggaataaaggtgagatgcagttccaggtaatggcagcatccaggggatccctggtgaaagtggagcaggaagaagagcaccgcggtggtagaggtcgagggtctgagacacacacagggatagcaaggacagtcctgcacacagactcaaaggggatggggggagctgaggttgagaatagaagaggacagggccatccctgaatagggggaggggcctggacttagatgggtgacagcatcaggaaggacagagagaggaaggatttggtcggatggcaggagcctggagaaaacaggtttctacaagaacagaagggcaatgaagggccagagtgtccagcactcctgggttacaaagatggcccggcatggtggctcatgtctgtaatcccagtactttgggaggtggaggcaggtgggtcacctgaggtcaggagttcaagaccagcctgggcaacatggtgaaaacccatctctactaaaagtacaaaaattagttgggcgtggtgctgtgcacctctattcccagctactggggaggctgaggcatgaaaattgcttgaaccccagtggtggaggttgcagtgagctgagatcataccactgtactccagcctgggcaacagagcgagactccatctcaaaaaacaaacaaacaaacaaaaaacaaacaaaaacagaaacagcaacctccagagagaggagtgagggaaacaactatgtctctaggaaaaacagattcaactgaggtggcagatatagggagcattacgtgaagaagcagagaattcagatttgaatcaggactaggaatctgtgaaaacagatgtcataagaaagtgagatggagaggcataaaataatggaaatgccaacgttccaataataagtgaatatatttgtgtgtatttgtatgcacacaaacacgctgcaaggggcacagagacaaactgtgattcctctaatcagaaagaccgggtctctgtcagtatttattaaccacctgggggtctctatcagtatttattaaccacctgcatgccccccagcagtttgtctctgtccattttcaaatcaggtcacttcaaagtgactataaatacatacgaaaccctgggaaacaacagggttccctcttactataagtttactataaatcatgcatccatcagtatatagacaaagttaactgcaatcatggacttttttttgagagggcagaagaaaacttgactcatgcagatagacacagtgtctgaattctcattttttaatgctccccaaagaagaatctgggacatgattactacaagccaattgcccaatctcttcccttctgaggcctgtgacataactatagggccagagttatgtgaacttctgcaggttcgtgttccccaaacatcgcaggagtgttgtcctacatcctggattttgttgatgatgttcatctcattttgcccaaattaaaaatacagaaaagttcaatatattcctcctagggcttaatttattataactgaaatgagggaaagcagttgtaacaggaagtcagaaaactttccctaaaacctgtgtccttcctgcaagccgaggtttaatgacactgaaatcttacatcattgcatcataaaacttaaaaggttgctttttgcataattttaccaatgacattaaaaccgatgcactggcaagcatgataaaatcttccatttgaggtctaaagttggaagacctttcctgtccaagtattgaaaaacctaggggaaaaagttccatctgctggtggagcgctcaagtttgcagctaatgagctttttaagaaattgtctgacttaagtgcatgtgggtttggccaactggatttttaatttaattaggtttatgagatgagaaatcttctgtagcgtagtcaggtcagaagttgccactcactgtcaccaaggactaaatttgtggctatctttgccctacttctcaaaccctgccagttgttaaattacattaaaggcaaaactggaatttaaagctgggactcaaacaaatacttatatgcccatgtttgttgcagccaaaaggtagaagcaacccaaagtgtccatggacagatgaatggataaacaagatgagatctctccatacaatggaatactattcagtgttaataaagaaggaaattctggtccatactacgacgtgaatgacccttgaagacattatgctaagtgaaataagctatacataaaaggacaaatattgtgtgaatctacctaaaggaggtaactagagtagtcacattcattgagacaggaagtagaatgatggttccttggaagtgggagagagggagaagtggggaattattgtttaatgggtacagagtttctgttttgtaagatgaaaacagttctggatatggatggtgatatggtttggatgtcttccctcctccaaatatcctgttgaaacatgacccccagtgttggaggtgaggcctgatgggaggcgttttggtcatgggggtggatccctcatgaatggcttggtgtccttccagtggtaatgagttagtgagagatatgattgtttaaaagagtctgggacctctgcacttctttcttgtccccttgctcctgctccctctcttgccatgtgatacaccagctctccctttgccttccgccatgattgtaagcttcctgaagtccttaccagaagccaagcagaagtgggtgccatgcttgtacagcctgcagaaccatgaaccaagataaatctcttttctttataaattacccatcttcaggtattcctttatggcaatgcaaataactagtacagatagtgatgatgattgcacaatgtgaatgtactaaaagccactgaattgtacccttacaaatggctgaaatggtaaatcttatgcatattttactgcaatttacaaaatggaaggaaaattctgagaacccacaagtagaattcagaagcatatgtatatttaaaaactcaaacatcataaccctcccacaggaatactgacatctctcaattcaatggcagtgggtatctccaagaaacttgtattacatgcaagtgactcttccctctctagagcattgatcttaccccctaggatgctggaatttctcctttcatttccagaatctatccccatgtagccacagagatgttatgtgtgtcccgcctttcccttgcactgcactctagtctacaaccaatgcccaaagttggctatgatttttttagagaccttattttgtctttcggtaactgtagctaaagtccaagatataattaggaactttaaaagagtgttcccttcatcctataaccactttacaaacactcaacaatttcctctggaagataatgaaacacacagagggcatctggtccctaagactaaacctcaaggtcaagcttggttgtagctcctcagtggcttaatggaacattgaaagcacccctagaaataacataaaattttcatcttctacagcaaggattttggcaccaaggtcttactttgtaaaaggcttatgtaaaaggcttatcagtgcatcccagaaagcaatgccatctaagccctatagtgtcaagggagttggccaaaattgctaaatgaccattcagctgacgatatgacaccaacatcggctgtgcaggtgcatgctcacattcctggcaccaaacatgtcacactccattttctcctctgcagaatcgaatctgaccataacaatggactgggcttgctaagaatgatactagcatgcctctttgttaagactttcagtgggttgaaatccaggtctccaaagagaaagccctaacctgtctacttctgacatctctccttcctgccctcacctcagaaataaatggtatttttgtatttacaattgaattcttacagacaaactacccttcccgaatgaagtagaaagtttcacaagatagcatccctcatgctcaataaattcccactcctacagcctggaaagttggaaggcagagtcagcagcataaacctctgcatgtgtattcgcgcaagtttcgaaagcctggcccacagcccctgattccaccttgcttcctacaatggtctcaccattctccctctcacccagtgaggactgggtgataataatgcctctgtgccccctctagcacaggggacctagagctctggctcactggagataaacagtcagaaaaccacatcctctacatgtgtggggcatttgtttgagggtgggtggatgagaatgtggtcaggtaacccaagctttccttcctccttcagcctcacacttttgcaaacaaaagagaagaaatggagtctgtctgtagaatgtcacttgttatcttctcaaggtcatttttaaaaaggaagatcatgtgtatgatgttcgagtatgcttcatagttcagcagaccaggcacaccaggtacacagtgaaagaattggcaagacaagggccagaaaatgcgtggagatctttcattgcacagttttaagagctttgacatagttatcaggaagaaatcagaattgaggtgggctcccttaagcttactgcatggtttttccatgtgtcaaatttatatgtgaggagaaccttcatcctttcagggtttacggtctcttgctgtcataacccgcctgcatatttcagcacagccccagcctgatcaccaatttccatccctcatccactccatcagaagatctttatgtgctagaataaatttctcttaacctcccacaccagcctacaagtcattcattcattcattcagtgcacaaagttgctgagtatccactacaggttcagagttgacctggcaggggacacaaaactgaagaatgccctttttttctggaactggaactggaattttcattctcgggcaaagcaggatgccagaagccagatgatgttcatagcatcaaaagactcttttttttttttcctgagacagggtttcactctattgcccaggctagagtgcagtggcacaatctcatctcactgcaacttctgcctcccaggttcaagtgattctcctgtctcagcctcccaagtacctgggattacaggtgtgcaccaccacgcccagctaagttttgtattttaagtagagacggggtttcaccatgttggccaagctggtctcaaactcctgacctcaaatgatccaaccgccttggtctcccaaagtgctgggattacaggcgtgagccactgcaccctgccagaatgtgcatttctaataagtttcaggtgatgctgatgctgctggttcagagaccacattttgagaattactgcttttaaccttatttataaaagataaaaagtttattctttcaagatattctttttctttgaacatgggtataaaaacattttaaactgtttaggtatgtgccatttggacaaaatctctttaatatatctataaaaatatactttgaaggcttccaaaggggagaaaaccggctggagctctttatcttgaattattgttcaaaatcattttcagagtctagttcattgggctggacaatgccagcaaggtgtttggtttttaattaaagttgaaatatcatctccattgaaaggtacctcatgaatttaaccatgatgccatggctgctaaaaacaaaacaaaacaaaacaaaacaaaaatacataggcttaggctgggtgctgtggctcatgcctataatcccagcactttgggaggccgagatgggcagttcacttgagctcaggagttcaagaccagcctgggcaacatggtgaaatcccatttctataaaaaatacaaaaattagccaggtgcagtggtgggcacctgtaatccctgctattcaggaggctgaggcaagagaatcccttgagcctgggaggcggaggttgcagtgagctgagatagcaccactgcactccaacctgggcaatgagagtgaaaacctgccaaaaaaaaaaaaaatacctcgtaggcttagatttctgaaaacatgcttccacccagaaccataaaacttgtaaaggtgtggctgaggagactttgggttccaaagaaagcattcagaaagcaccacaaatgaaaaataggagttcatcaatatactgtttcctttatcattagaaagaaacagtgctaaaaaagaagaatgtccacatgacttccaaaaacaaaggaacccagggtcatgactctgtctgtttttcccagctatatctaagacttagaggggagagaacagctccctttgtccaggttccacccactgcaagaactttttggcaataatatgacttctcttgtgtgctctgtgccagccaaacttcgtaagaatgctggccagcttggcgcaccctctccagcattacctatgtttgttatttgaagttgccatgctagattttactttaaatgacatttcaagtacacagggtagttgaataggtttaagtcttgttgtttcttttcttttcttctattgaataatcaatccattcaggcacagaaagatcaactcttaggcttccctaattaccctgaatctgctacttcacccaagggacctcttgaaagaccccaaggatgctttaaacaaagcacttcttactctttattgtagtcatgagttttcttctgagtctcttgtctgtgatctcctccttgaggatggaaagggtatcaatcatggctgtggccccaccattcactcattcatttattcaatcaatgtatatttattaaatgactgctgtataccaagctttgtgctaagcctgaatatgcagcagaggaccaaagagccacagcccttgccctcatgaaccttacagtctgaagtagggacagacactcaacaaatgaccccactagtgagtaaaatttgcacatgaattaggaggactctccagagaaggggcaatgagctttgcaggctgtggagtctaggggtgttccatggaaggaggatgagaaggagtgaagaagatgaagactaacattgctctcacagaacccagtgcatctaaagctccttaatgcttcccccatggatgcttgttgagtgactggatggacctaggcagagttttgcactcaatgtgacagactggggaggagctctgtgtggagcaagcgatgaagtcccactgaattcaattgagggaggacccactgtcttcaaaaaggaagaggcatctccattctaaaggtggagcaactgaggcccagagagcttaaatgccctgtataagaggcagagcttagtctcaaatccaggtcggactccctgcctttgttcttttaatccatgactccaaagctccttcctgaattggtgggtataaatcctcctgtctctcagaaacttcttctccactttcccttgtgaaactctgtttcatctcatcagctttccagagttatttggtgaaagagcatccaaggcaggaagatttttcttggatcgctgtgatggctgcaccctccaaaaatgggttcacaaagggtaagcatcggccccactcattttcccaaaccatagcaaccctctctttctctccaagaaaattttaagttgcctgcatcactgtacatattattagcatattttccaatctcatatcagaaaagtcttctaatgagtcccaatctaatgtgacaatcatccaacaatagaatggctgctgcatgtggcactgagctttcagtccctggggacatttaagttgacacaggagatcacctgccaagaataccataaaaggaattccctgttatatcagaatgctgactgatttctgatggcattttaataagccaagaatagacgcttcttgacagtagaccctgccaagtgaatatgcctaaggagactctacttcccagtttgcttgatgtcctggaataattattaagagcacctcctttccactctcacaagtgccctgagtagatgccaaagaatatggtcatccaatttaagttgcacttgggtccttggagagaggcctaatacatcctgacacactggctgccaaacatccaggagaagatggggaagcacagttgagaatctgcagtgctcctgtagccactctaggagagtttctagttctctgtttagtaacctgatataccagcaggcgaacgacaatgtctaaaacctccatagttctgtgcctacacacaggcacacacacactaaaacacacacacacagacactcatgctgttcgcagagtataggagattctccgagagaagccagtagcatttccatgctgctagtggtctgctgatgagtaagtgttgtttttttaaggccttgtctggcattgaacatgattaataaattgctggagatgatggggactgctctactgtgattgagttactggaggcttacaaggatgaaaacagggatctctagatttcagatcaaaagcagtccataaaacacagcccctcaggtcatgggaagtggcatccgcaggcttctcaagatcgcttcccggtgaaaagagtaaaccagcctctgatcccatactgaactctaactcacatggggttcgaatgtgtcatatgctctctgtacctcaagtaataaagcagggagtagtgggagcccatcgcttatggctacttttctcaggaaaacttaagaccatgcaggatgggctggctcaattttgacagagagggtgtctctgcactgctaccttagtgcgcacagtgatttaatgaatacacgcctcagtagtgactgaacaaaagcagtctccaggagacgctgcaccaatgcaaagaaacacaatccaagcatcttgtggcagaagtcccagcagtccccagcctgggaccaaaggaggcctggccaagccttgatataagctgctttcccactgcacaagggcagagtccccaagtgaagaactgccccagttctggctcaaggagttggtggtcactccttgtcttcatttcaggggcttctagaagaccccctttccccgaaaagtattctctatctaagagcctgaaatttcaccattagagattacttcctttcaattttaccttaactctctttcttggacttcttaaaaagcacaaggaataaggagcaaatccatactgagttgttaatgatttcacagggtgatgttgaaatggcagcctactgaatatccacttgggctgtaggttacaagtgcatttccaaatattctgattccaaaggtctgatgaacagcttagaactctgcattttcaacaggcaccctgcacccccatctgctgtaattctgaagcactttgagaaagttcatttcaatgcaccatatcctctcagggaaagataacttcattcagagtttttaaaacctggattgtcaggttacaccccagagcaattacatcagcatctctgtggggaagaccaggtatcagtatttttctgatgtattagaaaaagaaagctccccaagtaattccagtgtgcagtcagggccgtggccacctgaacagccaatgggtgggatcttaatgctaacacagcagagcaaatggaacatgtgactatctccagggatctgggctgcctgggactcaggtctctgcactggcgaagtgggcagctacctggtcttcaatgtccccacttgagtgaccctggaggagtcttcagttgactcagttatggaggagccccatctcccctatacaaacccacacctctccttgaaaccacggtgatagggaggctgccccaagctgtacctctgaggagatacaggtaagtagaggctgggacagagccagacccagacaatgattggccatttgctgccacttggatttcagtagcctgagttgctttggcaggctgttccctggctctgtggggtccctcaagcaagcacagccctctcacctcctgcttttgggcacctctgggaccaggtgcaggatttggccctcaagcattgtgctgggtggatagctgcttcctgccagtggcaatgcaggcctcattccttgtcaaggaacaggcaagggcagaaggcagaagtcacatatggttgagagactctctaactccaactaaatccacaccatttttgagcaaaatgggggttgtgttcatgtatgagttcccaccaatctctatccatgtggcaattccatctgcaaaacccaagaaatagtggtgcatgttggtcccggggaactgggaactggagtgagctcagcaagagcccagaagtccgggagaactggtgcttaggatgatggctcaatgtccacccaaaacacagccgttatttcctctttgttcaagctctctttctttcctttctttcctttctttcttttcttttcttttctctctctctctctttcttttttttttttccagggtcttgctctgttgcccaggctagagtgcggtagtgcaatgtcagctcactgcaacctctgcctcctgggttccagcggttctcatgccacagccactcaagtagctgggactacaggtgcacaccaccacacctagctaattttttttttttttcagtagagttggggtttcactaagtgattggcctgcctcggcctcccaaagtgctgggattacaggcgttgaggcaccgtgcctggcccaagcgctctttttagaggcttgagggtaaacttcatcccagctccctctaatagaaatattcaaagattcaagccacatttgtaattttgaatgtcccagttagccacatttcaaaaaaaagaaacatataatattagtgtgtaaagtgtttcatatttaacccaatatatccagaatatttttacttcaacatgtcattaatattaaaaattcctaatgagatactagaaatacttcatgcacctgacacccccactgaaatataacagtgtttcatgtgttgcaacaattgttgcatcttgtgaaaattagtcctaccaaaacaacaaagtattgtttaacagacaaacattttatattccttcagtttttaggtttatatttttgttaattaaagttaaacacaaattaaaaactcagttcctcagttgcactggctacactgaagtgcccaatgggcacatgttgcaagtgggtaccatactgggcagactgagaatgtttccatcagggtggaaagtccttagatcccttaaataattagaaaaggtcccaactctcattctgctggtccaggctagagacacttagaagtgtcctgagtgacatgggtgctctctcgtctcacaaaaaagaagcacaagagttaagggctagaacagcataactagaacacctcccagagatgtggcctagagcaggtaactctcaaggctcagttcctgcctctgacagaggagccgaagatgagcatctaccacaaagaggtgtaaggattgagtaagttaatatgtttgtaaaacactcaaaacagtgcctggcacatagcaagctctctagaagtaagtgctaaataaatccccagttcaatggctgccagttggttgccagacactctgacatctttcatcccagaatggccttactggaagatgcaaaaaaaatctctcattgtgaacagctcccagccttctggctgccaaaattatacattgattcacctgagccttacctgatgcaaaacaccacaaccccacaccctgggggaaaaaaaaagctcagatactctgaaatgttctagaatgtctgtccctttcctatcctccaaaccatatcttcctgaccctccaaggtgaggacagaatgccatcccttctccaggttatttctccttattcaggtctgagtccaggccagctcctcctacaaggcctttcctgactatcctttctaaagcacgactgagttgtgagcaagcaagtacatgcagttaggtgcacacagcactggcctgtcccctcacactgtttcatttccttcattggcttatcattccctgaaatcacattgttgacttacttcttacttgtctattgcttgcctaacctcaaaagaaaataaattctgtaaggacacagacctggtctgttcagtccttgctgtatctctagcacccaggtgtgagtacctagaacacagtacatgctttatatacaattgttgaatgaatgaatgaataccctccttaaagtataggttcctatttccccttgcttgatattccaaagcactttccatctttcatattttgaaggcagtcaattccataatacttgatacatacagttaactatttttgtgtatatgtcttatctccccaactagacaataagcccctttgatggtatgtcttgaatgtacatccctcctgaggtcctcttgcatcctcaatgaatacttgttgatgaatgactgggaagaataaagcacaaatcttaaattaattttcttggtcacacatactagactatttctacaaataataatttttaaaatgaagtaaatatatatatatatacacatgcatctatatatgtgtattatgtttctcatcctaattaaatgaagctatttttgcaactgttttccagtccaagtgtaaaactgtaaagaataatgctaaatgttagatcattaagttggttttctttaattatatggcagtgtttcaaaaaggctttgagtcacctttaagattccttgccaggggtacagcacactacatttaaaatggcacttatcttagtaaacacatttctattgcaaatgatttgttccaataagcaatcccttggcaaagagctgctatttcttctagaccccctaccaaaacatggacctattataagcgccagagaagagaaagcttaaaaagcttcctttatcagaagttaccaagatacattccctaaagcagaagcatctattcatctacccttttctctgatttcaaaacctatagcacttactttttgtaaatatcttctataaggtagctgtaaataagtcctcaaaacctattgtgaagtaagctatagatgtaaatatacattcatcttttttctctctctcattttctttcctcctgcctctctcttattctccctttgtttctgtttttctaaaacaaaaatcagtaggttggtcacaggcaaatacaagttcaatttctaccagaaagctgagttcttgagtgattaagcatacaaaccaatcatttgaagggaaaaaaaatccagtaaaggctaaattattttctgaagtacttattacattacatgaagagcttattatgataagctattatacttgcaagatgaattgaattcacattcaggcaactcatctattcctagagaaacacagataaaaaattttatagcaacctgaaaaggtttgtggaatggatataaaagagatcaatactataagattttaatgtcaaattgaaacaatagaaaacatggtccaaaacaaggtctcaatttccaataaaaaggaaaagaagagataactggtgagcagaggagaggacagtccttcaggcaggagtggctggggaaggacctggtggaagtgtaattaagctgtaaaggaatcatggatagaatttggagggtggaaagcagtccacctgtaagttcatttattccacgtgtatttgttgatttcttactatatgctgggcaccattcccagcacaggggctatcacagagaacacatgacaaagaccccttattcagatgatattctagtggggaaggcaccacttctagaaattagttatgaaaaagcaggcacccttttatgtttacgtgtacatacatggaaaggaggcattcatgtttttgttttctactgcccttctcttgagcctggaaggttttcctttgtactgatggctagcattcctcttagctttgtggagatttgccttgcaaacaaagagttccctctcttccctcttgccactgtttaccatggggatgcagttaaggatcatgacaagccataaaagatttctcctaactctttcaagtatgactatcctgattatagcctccagatatggccagccagaatcacacactatttataggcttaacccacaggcagaattagtcatgtatcacacatgactaaaatgcaagactctcccagacctagggtcctaaacaaatcccctctccttccctaaaccttccaaagaagggcagtgaggatgcccccacaatgttcttcctacagacatgtttatttaagatctcctccccatcccctaatcaaggaaactacacaactgagctaatcatttaaatgatgctactgagaaacgaagccattttccttgttaaaaatgtgcttgccaccctatccatttatctatttccttggcagtgctcactgttaatttattgcccaataaagcacagacactagcagagctgctgaaccatgcctagtggaagccccactatttcatcccagcaaaggcaactgacaagcccaaagcacaaacacaaacacattggatgccacaaagccgggctggctaaccccgactccatttgtcatcccagagacacagaagggagggcggtttacagccttctggagaatgtaggtgattaataactatcgattgtcagaggaaatggagtaagtttggtcggttagccaactgccatgggttttctttctattggatggtaaacctcactgccgcagaagccatctcatggtgagttttgtggggagagaaactgagaagggaagtgatgaagaccgagatggggcagccttggctggccatggtgtccaccattcgggcagattgcctcctgttgcctcctgcagctaacacacagccatcactcataaagtcccaggcagatgtgtgcttttagtgcaaaaccttggcaatcattatcttgagtgtggaggggcttttcttttcagagtctccttcatgggcaactggatcaaccacacagaaggcagatccttcttatttggacagcttagacctcagagagcctataccaactgaatatttgtgaggtaggatctgaaagcacaaccctgagcttcaggatactctttctgatgtcttgactagctccagtttgcctggaggtttaaaggaaaatgtacccagaaaacctgggctcttactccagtatctgtctaatacaggaggaggaagccttctcaaagccaaaagaacagaacaccaagaggggttccaaagattgggttcaaaaaagtcattgaatgttactttgagaaggaagcaaggtcacctagtcgtaagcctgtattttagaggagaaaactgggacccagagaggaattgacttgtccaacgccctattgtgtgttatggacagaagcaaaattaggaggatgggtgaaaaagaaggaagttccaaaagcccacagggtctgccttccattgccatagtcccaattgttgctcccctagtgagggcacagctggcctaaccactcacaggcaaaagacataagactacaacagaccccacaaaacacatgcacatcatccactcctgcaggaagttgtgagcaggttgccctgctccaccatcactgctcagcaggaggtagagaggtagatgagaggagcacaggacctgagaaccaggagaaaaggatggcaagggaggcccagccccagccaaggcccagcccagttatgtaatccaccctgggaggttatgcccgctgctttccatccacggattttgcaggatgggtcttcactaggaagatgggggaaatgtcccagagggaatcctcaccagccctgtcccatgtcaagttctttatgcctctgaaccttcctcaaacggtgtccccccttccttgcccttgccccacctctccacattcacagggcatcttaattccctaagctgagtcaacatgagtaccacagtcctctccgcttaaccaggctgctgcatctcagagtgagcctcacagacacgcacagaatcagcacctgctgggcattttcatgtaatttgatgatcacctctgtaataagactcctcaggagctgagaccatccttcgtctaccttctagcattgtgtctccattgggccattgaggccatctgctctggaagttcctgcaggggcctgctaacaggtagatgcctaggcctaatccctgacttgcaaactcagaatcttgagccagttcaggaataactgcctagagtgcctcccacagcaaagggcatactgcagacatcaggaaacactcattgatcacagagaggggcttggcgtcaggggacctaattttaaccttgctgtgtggccctgcggaagtcacttaaccctctggtattcaacttcttcacctctaaaataaatgtcagacatttgtggatcatggatgtgaagttaccaacacagatccaggctcagcaggtactcaattcgagatgtctgtattatgcgtgaggtttgttcatacacagattgacccagtaactaccctgaaccagatccccagggagtgggtttctaaaggctggggactgggcctggcttgagaatatactaatcacacaatatatttataatagccaaacacactacataacctatcatattataaatgaataatactataaaatattaatagcaaacaaaatatggtacatattttgtgccaggcactattctaaatattttacttatatttccccatttaatccccacaaaaaatttagaagatagttctattattattatccccactttatagctgaggaaactgaggcccagggctgttaggtaattctcccaatgtcctgtagccagtaaatgacacacagcggggattcttcaaactcccacaccttcctgagatgtcagctggctgtgtggttcatgccttctcttcattgtctctgccctgagatgtgctcagcaagtggtcgttgccttaagagagctttgccttcccagcatggttgggggaagctctccctccttcaagggaggagaagaaggggtgaggagccactaacagggctcacctgcaaagttttcaggaccatacctccaggccaaactctaatgagaaggagcattcctgggcctcagctccctggggttcagacttggccccttaccataaagaggtcaactaatgcaaaatgcagaggctgcaccatgatagcttttccacgatgggtctgggccaggattgagggcactgtccagcaagctgatgcatttttaaaacttccgaatcattgatactacctccccagggaaaggaagacctcagcagtttctccaacacccagtccacatgccaacctgccagagaagctgggacggaccacagcaaaagcaccagcacccaagctctgccacagacaactgactttcagggacatgaatgacctcctcactgaaaatgaccttccccagggggcttattctctgaacttctggaatcaccaatcacttctccatgtaactgactctacatcaaagtcgatgcaacagatcacatttctcaccactcccactgccccaacctggatgcaaagtgtcatggtctttcaccagattattacaataacctcctaagtggtctccctgcttctacacttgaccccaagtaccacaattggagaaggatgatctccaaagctgcctgggaagtctgcagttacgcctttggacatggactgttgggacttttcagtttctaagagttcaaagaaaaaagaatgctagagatgttttctttccatccaaacaactaaaggcttgtatctttccattaatcaataccaagagctgttcatgcagctcaaatccaaaaatgagcatgctgagtttctcaagtctgtcctctgatgatatgtatataatcagcatgctctgttgtagacctttgtgacaatctgtgtcacttagtacaagtttacccaatgtcatttgcatttaagcaaatggaaaagaattttctcagaccctactatgactctggccacctgataggtgctatagaggacaaaacagaaatataaaatatgattctctcctttaaggaatgtattttttctgatggagagacaaaataaatgcccaacagatagacaaacaaccatatcagaccatttaaccatttccatatggttaaatggaaatatcagtaggaaagatattaaacaccttgggaattcagaagcagatgatcagtttggctagaatggctgggaagataatctatcaaaagtaagaaaagtgataaatgtgtgaagtgtaaatgagttgtagtattgcatcccaacaggcaacaaatatttcgtgcactggattgaactgctgctaatactactttcctctctcctgcatttggaaaaaaacaaggtggtctccgaaatccagcctcaacccaggactatggaaatttgtaatggcagtgaagacaaaaaatattttctctgccatatgcggtcaccaaaagcaaagcaaaaattaaagcaaagtatataggatttggtatggtaaaagtgaagaatcacatgacgattcgttaaagaatataacctccacccaaggggacagttgagggatagcaaagtcattaaagcgtcacagctaaaaggaaaaataagtctttcagctactattatccatccctctgctattcagtttcatgaagtgaagctactggagtagacactgtattacatcacaaatttgttacagacattcctgtaaaagtggctttttcctcatagactgaaaatacacctgaagatcccctcatgatgaataggaatagtccattttagatgagtagattttggaagtgtttccacacttttttttgtttttaggtttttggggggtgtgttgttgttggaagctccagcattttcctcttcaccacctgcagcactgggacagcaaagctgaagaatctcattaagcttcgacaagaccaattttttatttttagccagtcttttaagacaatgtgaactctactacatttagaataattattccatcaactatttacttaaacattttagaggaaaggaaagaaactgggagatgtttaaggctttttataacagattgtttcaagggtaaatagaaaaatccaaatgcagctgctgaaaacacgtaagcccatggcagggtgcccacttgctgcagcggaagtgaatggtgagaagagatgaaagatgtggaagacaaatgtacccagggcatccaatcccagcaagcggacaaagggcagattcataacactactttgtggttaactggtaactttcatcagggaacctcaacacactttacaaataacacttattttcctgtctcacagaagcagggagataaatgccaagcccaaacgtcacacagcaagggtgtgatgattttaagaataaaatccagaccttatttcccagttggtggcctaccaggtgtcttgatatggtttggctatatccccacccagatctcatcttgaattgcagctcccacaattcccacatgtcatgggaggaacccaatgggaggtaattaaatcatggggcaggtctttcccatgctgttctcatgataaggaataagtctcatgagatctgatggttttataaggaggggtttccctgcacaagttctttcttgcctgctgccatataagacttgccttttgctttctgtcatgattgtgaggcctccccagccacatggaactgtgagtctgttaaacctctttttctttataaatttcccagtctcagttatatctttatcagcagcaagaaaacagactaacacatgcctcccttcgaacccacagtacatccccaccatttgctctttccataaaccagtttcctttgaaaacttccagatccttcctcctctaatagagaacaccaacataccaaagactacttcagacatgaaagaaatggtgtgcttatcttgaaatctcaagtggaatggtaaaaacttacctaggttcatcaatgcgctagaaacaccacaaattaccaatgcaggggaaaatgaagtatgctgctacaagggatgcattgacagactccagagaacgccactcttggtaagctgattctgaccatatagaagttattttataattctgtaaattgtacataagtgacagcaatgcaaataattcctgtccatggacatgaaaattctgtcctgtccaagagaagttccattgacttctctcctgcctttgtggaaaaaaacagttttgcctctgtttccacattcatttaaatattactgacctgtaagtgtctgttcttttcttttttgtttatgtttgtgtctttgtttcttcaagacagggtcttgctttgttgccctttgttgcccagactggagtgcagtggcacaatcatggctcactgcagcctctacctcctaggctcaagggctcctcccacctcagcctcctgagtagctgggactacagacaggcatcaccatgcctggcttttttttttttttttcaggtataggcagagtcttactatgttgcccaggctggtctcgaattcctgggctcaagtgatcctttcaccttggcatcccaaagtgctgggattacaggtgtgagccaccatgtcctgcctgtcctcaactggttataacatctgcctggtcccctcattgaataggagtagaataaaatctttaacacatattcattttgatatctgaaagtcatgattttcttcttttgtgaaaattaatttttaataccaattcaatctcagaaatgctcaacctcaaagttagaaacacagatgggaacagcaagagatgttagaactcacaagaggactgatggagaaaataggggtgtagatctccgaacacaaattggaaaagattttcttatgagaacaaatccataaatcagaaaatatctgtgattttatcctctatcttcctaccacttcaatcttgttaactcaaatataagacatgttaactggatccaggacctgagccctggcaagtgccacagacaacagcatgctatccaaaggactgcccttaggaagcccttaggaagccttgaatgcattagaaaaaaagtactctcccctctggctgacacagcaccattctggagcctctggcttagcaaaaggggtacaggttgcatttgagtgctttcttgtaccttcttcagctgggcacctttgtgcagtactcaacctatacaactgtacatggtggccatgaatggaaggaccactcatgacccaggacccaaaaccataacagggatatatagctagagaacagctgctgctaagcagggcatgagagaaactgagagggctgtgtccgggctgactttatctagaccactgagatccaatacgattgaggaaaatcactaactctatggcaccctgctccagccatgcctgggaaccggtgactgccttatgatgggatgcccttttcagggagtcaagaagtgcctgactggtaataaaaaggaatgaactactgatacctgctacaacatggaggaaccttacaatcattatgctgcatacaaaaaagccagacataaaggattacatactgtatgagttaatttgtattaaatgctcagaatagaaaaatctatagaaacctaaaaataggttcacacaaagtagattagtggtttcctacagctgcggtggttggggagcggactgaagggatttccccagacactccaatccatgtgtctgggtgttacgataaccatgataataaaagccagggagacctcagtttgggttaacagggaggttaacctcattttcatgctttgtttttcaacccttattactgactggttctgccacgatccttaaaacatgctcttagcaaattttatttttagtaactatcacttagtctttctccccagctttttcccactttcctcccatcccttagatcccatctctcacatctgtatgttttacccaacaggatggaaagagaacaatgtgtgggggcagatttggtacctgtcatggccttgacctctggcatcaggcttcctctccctaaacaccccagccaggctgcactttcctccatgactcaggtgaaccttcctctgtgccaccacgtggactttgcaaattctgtttctcctatctgcaacattctctcccattctcctcccaccagtcttctttcatcatggatgaaggatgactcttattcttcctcctaatctcaagccaagcattcttctcggaagcctttgttgatctttaatcccttggctctcatagcagaatgtgtgcagggcaggtatattagaatttctgtaggttaaactcataaactgtgggactttgttgactaggtgacatcaagggaaacagaggcaggcttcttctgtggaataattgtgcatccttcctgcccttctaggggtcctgactatctccccagcccccagcctcccaggctccaatctgcaacaacaaagagatagaagctctgataagaaacacaggtggctgggcgggtggtgtgctctgtagtcccagctactcacaaggatccccttgagcccaggagttcaaattcagccggggcaacatagcaagaccccatctctaaaacaaacaatcaaaacagaatttctttgctaattacttttgacataaaaaaacaaaagaaagaaacacaagtgattgtagcaccaggacccctgaagctagctgaatatgttcctgcctctggcagagtaaatgttctctacttttgagtcagaccagtgaaggccaaccttcgtcttaggaagaagttgtggtgccaacataagctttggagccaaacagacttagttcaactaccagcctttacctagtttttggtgctcccattgactagtctgcggcaacagatgagttaaaggagatgttgggtgtgtatcctaacacactgcacaggctgtgttgcagaatagtcagtaaatgtccattttctttcttcacatacaccttcttctttctgcaccaataatttaagtaagaactttctattttctcctctaccaatctcagaactgtctagatagaagttaaaaccacctcactctggctcgaggaggagggagaaggaggcagggtttcatttcaagatcagtcagcccattgcagctggctgtcctgcagcttcaggagaaacaccagtggtcccacagctaaccaagatggtgcctgtcaggcacaacagcttgatagggacagccgcattccctgtcagattcttgataaagtacagcacatgccaggaattctgtgggcccttcaggcacttgtgctgttgacacccctatggctcaaaatcagaagctgtctctgaatttgatgaggtggtagagttggatcctttggcattgagggaagaatggcagaacgtgggtgtttacaaacacttctgtccacttatgtatactgcagatacttaatggagtgctcatcctgtgctgggatagaactgagacaaaaaacagatagtagctgctttcagggaacttaacaatgtcagttaatgggggagacaggtatccattcataatcatccccaatgaatgtgaacccaaaatgaaataagggcatggaagaacataacacaattctagaagagctgctcacaaaagatcaaggtgaaaagaagtttctcaagaaagtcgcactggagctggcatctgaagaatgagtaggtgctatttgggtgaaaggcgtgtgctgtgggaaagggatgggaagaagaggagaaagagagaacagcatgtgcaaacagagggaacagcacatgcaaagcccagtggcaagaaagactatggcgtggtgaaaaattgggctaaagacaatatgaccagggctggacactgagggtgagagtgaaatgcagcattggggaagagaaagtcaattcctaattgttcaggaaaggtgactgggtgataggcatgaccagaagaagagaggtttcctatgaaactctgtactggaaatagagctgccacaataggcaacaagaactaaggtacctagaacaaaatgctctgtcattttgttccctgggagagtagagtaaaattcaattgaacagaggttgagacagcctattgataatttaaagaaaaaaaatttaatgggctaggtcatcatacaggcatattaaaatgtaaaacagcagaaccaaatcaaatttctctttgacaggcttgccctggttttataatccctctttcaggggagactctgttgttgttattattattattattattgctcaagatggtgtctctctatgttgcccaggctggagtgcagtggcacgatctcgactcactgcaacctccacctcccaggttcaagcgattctcttgcctcaacctcccaagtagccgggattacaggcacatggcatcacacccagctaatttttgtatttttagtagagatggggtttcaccacattggccaggctggtcgtgaactcctgacctcaggtgatcctcccaccttggcctcccaaagtgctaggattacaggtgtgaaccaccgcgcccaacgagactctgttaagctgaaaatattgagctaaatgccagtgtcattcttctgtaaatatatgtaattgccatttaaagaactctcaaattaaggttataacagctagtgataaacattccttcatttctcacaatattataatagagaagaggaccagcattaacaaactggcttttcctgttctcccgaaacagtcttaagtgatctcatttatcatgaatttctgtaagcattaacagtttgtaaaatgagttaattatgttctttggaggtttaataaaatctaccaagttaagtaatatcccgatgctcttgaaatttacccagaaaactttaaagaaagaaataaatgcattcgactgagcagaacatcatgtatatttttagaaagcatacattatctcacaatacttatgctaaatatgtaagaaaatttctgatagactctaaatcaagtctagttgtaaaaggatctctcctctaaagttttttttttaatcttcgtatcaatgtataaatattggcatctatgcaagccaaatatattccaaatccaaaagctttggcaatccaaactttgagagaaagaataataaaatctaacctttaatgagaaaaagtaggaatttcaagaacatgcatctattttctacaggcagtggtatgagagaaatagaacagacactgaaacaggtgaaaattaagatgttacatagggatggcatatgggactcattaagtttaggatggtgttttgcccttctttaaaatgtgtttttcttttcccccaccataaactcaatttgccccaggtagtaaactgaaatgactggaattttctctgattagatttctctggggctgttactgggtgttaccacatggcataggggtgaggtgccaggctctggagtcaaattgcctgtgctcaaatgctgcctctgccccttactggccatgtatttttggaaaagccagttactatctctaagttccagcttcctcatctttaaaggaagaggtttgttattatgcatacctcatgggttgttcagatgattagatgagatgtgtgaaaagtacttacttagcacagtgcctctgtaaaggacagcgatcagtattcccctggtggaaacagtggccatgtttacaagatgaaggaggaaccagtccttactgcctccctgtgtaatcaaagtagtcattatctcctattgccagggtttccttatctctatcactcatgtcctgtcctgacaacatatttataatgggactctacctacacaattaattgtgtaattttttttctttaaatctcattctttaaagttcaatttttaaattgaactttatttcactaccacaaatggaaagcccatctcacttgctataactagaaggtaattctaaacatacagcaaaaaagaaaacccagatcatttaaacgccacctcgatcttgtcaccccaacaaagactcagagcctgagagcggaggctgattgccaaagtttagagaggtgttaaagacctggtagaacctagggaagacattctctctgtgttaaagagaatgtaaaagaaaacataaccctctcctcattggagtctgtgtcatcctatgctgggtcaggccaccacctaaaattacgccatatgcccctggtaatacccatctctcacgttgttatctagagtgatttccattgtagtttatggagttttatgcataaacagacagtgttctgtgatacctaagaatacttccaaaattcccatggaaggaggctcccaattaattccagtccattcatttttaaaattgctgagtgaggcattagaattcatagaatttgcagacctgtgaattcccctagccagcagcaatcttattagcatatccgtaagtctttgcaaatttgactagggacggtgtgtgtgtgtgtgcggggggggggggggggttccattcttactttatgcatcctcatttatacaccctcctctctcttgaggttgagtttctaagctgatagatcataccttccatctctgtccataaatgcctttgacccaaatatcatgcaagtccaatggtacacatgtcctctaaaacaccctaagtggaaagcattgcctgttgaggattagagtagacatataatcacgtttcatactgagctatggccttcatccaatacaaatgccacattcacttaggaagggtgtgtatacatgggaaacagcaggggaatcaaggacaacttcctgaatcagcctgctcagcaaatccaaactcattcagccacaaacccagttcattcatgcatcagggtttgcactgctctaataagatgaatggaaatgcaaagacaacacttggagggagtcctctccgtgcactgagacccttgtctgaaaatacaagcaactgctgctgcttcacactcaaagagccaaacattttgcatggataattcagaagcagtacgtcactgccccatacacaatcctcatgttaagggagcctgcatcaggaaagcacagactatctacctacacaaagaggtcattgcaaattcctcctctccttcctgttgcattcactttagcaattttattacagaagagactgtctagtccagaagcttgctcagtgatgaaagaagccaatttgggatcctaaatttgactatagagcattcatatggacaactgggaattacctggtttgtgaactaagcaaaagccaaaactctaaacaccttctgagcatctatgaaaaagtatttccaaatcacaagcattcattttttagatgggagttggcatgaggatctcctgcaaagagagagagagaggtttcctggcatgggatggggagtgctgagcaccaagacacatgtgcaagctgaaagcacaccaagtgctcttctctgcatccagcacctcacacacattaactcaaagggctgacaagtccctggatcactcagcaggcaggcagcaaactctcagagcaaacagagttactgctgccttatcttgagctccactattaacacacttgtcatcactaagccaggttgttagtctctggaacaatttgatggaaagggcaaacaccagagaaaaacaagttgacccagatgggctggcagaggggatcaagtggcaataaactccgttatcactcctggttggcaaacaaaaagctctgcctacgcatgcattccagttaactatggacttcccctcatacatgcatggaaggccattatgcagagaaatgggcacagcaaatcacactaaacactgaaactctgctgaagtgactccagtgacttggagttgttgatctaaaaattgcttattcttgccttgacaataaaatcagagtccaagttaataaagatttctagttagcaaagtccccaagagcaaacagtttattcagatcaccagctttctgctttgcagtgtgaagagattaagggtccagggacactcctagttctggttctgcctgtgtacatcactgagcctttgtagacctcagctttattccctgtgagacttagactgatcagcagttctcaatctgaatgtgatgacagagtagcagaggtggccgaatatagaatcctcaaaattaacttacaaccaaaggctggtatctgtcagtagctttacatgtattgactaatttaatcttcacaataaacctgtgaaggaggtactattatcatccctattttaccagtggggtaaccaaggctcagaaaggctgacaacatgcaagggtcacccagccagccaggtgcagaggtgagactaggaatcatgtggtctgtctccagaaatgctgcttttaactactcaactcttcataatctagtgcctctcaataatggttaataatagctatcagtatggccaattgatggcctgattagaggagatctgaggcttgaaataaaaggctactgatactcgcattttaacaagctttttttgagagacaaagaagtggagtttcataacataacctggagtttgcatctcaaaagtgaacaccatccacaaggccaggcaagaagaaaggttggcactggctgaccacacaatgtggttggttccacctcacttagccatggagtctatgattccttggtgctatgagaaagaatgctgcaatctgctcactctcattttgggaggaccaaagccctgcctagcagcaatgacaatcctggccctaacacagctgggagcctcttgacaggcttatctcctccagctccccaggaagtctcccattggctgtcagatcaagatcaccaaacccattctcctaattagctccttggcaggcaaaccacacaggagcagttccctttccaccttgaacccagcagacagtcccactccccagcatcagccagccccaaaggcacagggctcccctaaggcctgcatgccctaagtgtctgagaggaccccatgactacagcacatgtcactaagtccctaacattccaatcatcagcaggcatctgtaactccagccggcgtccctccaggtatgcaaatgccatctgcccttacatgagggaaatggacagcagcggaagttaccaagggcccacaaggtgtcagcatctgggacagaaatgaagttccctccctatcaccaacttctcttttaaagaaccactcaaaccctgccaagcttgtacaagaggagtaaataacaaaatgacacagatgacccataaaggatgtatatttgcttaaatgaaataatagagtacttcacaagtgcctggtccatgtaagacttttgttttgttttgttttaatggctatttcaatataacactaatttaatagatatagtttaaatataagggactgtaaatagagtcttcaaaatagtacatcaaaaatttccttcatgatgaaatagatggcctactatgcttatccagagttattcttgcaaatttctacctgtagatattgttcggcaaataggcaagttcaattgattgttgattttaaataaaagttctaactgagaaaaaaaaagtaagcccataagagaaaccagtttcaaaaggccacatcctgtggattctccttatttgacattcttgaaaagataaagctatggtgatgaaaaacagatccctggctgccaggggttagagatggaaggaggcggttcgatgcggtaaaggcacagttccactgattatagtggtggttacacgcctccatacatttgtgaaaattcatagacctacacaccaaatttttttaaaaagtcaattttattttatgattacctaaaaaataaaaatgtttacaaggcccatgaattgggttgtctctaaaagatgacttttcttcatatttcttccaaattggttcatatttagagcactattgattatctaacaaaattttaaatggaaatagttgcagtggagattaaatgaaataacatattaaactgcttttgaaataaaaagggcatggaggatgtcatagaagtagcggtgcttgcagtaagaagtcagatcagactttacaaccttgttaaatgagggactgaaggcctggggtccccaccactccttcccgtgagccagtgcccttcgtactccactttccttatgtgtgaaaaggggcacctgaggaagggttgtatcttcaagcactttaatcccattacccaattattcacgtgcacagacccataattgggagttagatgttttccttcagtgctcaaaatagagcaagtttgtccctcaaaaccaaaagtactcaggtcatgaatgaaggctgaagaaattctgatctggcgggaaattccactttctgacaaccctgatggtacctctgaaaaaaacaaacacaatgactgcttttgaagggcaggagacagaaagacttaaccagtacttttcaaagggaggaaaattctgtgtcatcgtaagcttgaataaacccagtgctgtgaattgccaaaggagaggttaactgttttgaaagctgtggcatttttctcatcagtgtctcatgaggctggccaggaggggcagttggaaagaaggctcggagatttgatattcaggaagtccaccagacatgcagcattcttgacaagatgcctttcacctaatgtcatattagcaattcagacagaaacccaggaaagttagcacacacatatgccccacgctacacatgagccctcctcccaaaccacagcttcccgtgcctctcttccccatgaatttagtaccagcctccaagggtttctgccttcctttctgcaagtcaattgaagtaacttccagaaatgccttaattacaggccagtatcactgtcattagaggtttaaataaaaagtccccggattctaacctgctgagatttcttgtatgaaatgtacttacggaactttgataaagtaccagtcaactctaacacttaaatgggaaaaactgttgcagctcaaaattcaactctcatgcaaaactccagggatgaggcagcaaaggtaccacctcagcaagaagaaaaaggaagagagaaaaaagaaaaacaggtactccataaattacccacataaatcagtttaggcagactacaattttttttaacacagaaaacgcttaaaggaaaattcacagaaaatccatgattactcctttagcagggcgaaatgtcccaataagaaggagatgtattaatgggtggccaaccacctcttttgctccagtcgccttccgtggagaataatcaacagaaggaaatctaaaaatcaacatagagaggctgcggtgagctgcttcatgggtcctgggatagggggcatctgaactatttcccagcgtctgggggaaaaggagtgaacattttcaagtgcctcatatgtgctggtgctttacttgggctgtttatttcattttttcatgttctttcaaggtgttcttaattctgccttacagaccagtggaggctccagtatgttagataaattccccaggggcaccagttaaggatcactaggaatgcggaattcccctccagctcagctctgccctgaacatcttgatgccaggagtaaattcagggctctgagaagggtcccaaatgttacaaactttaaaattgaactaagggatgaaagtttaaaattgtcttcaaaggaattcctcaagtaacataaccctgcacatataaaagtgtcagcaggctcagattaaagggctcatgaaagagggttatttccagagataagaatccttcatcctcctctgggcagggcagcagagatagaaggcacagccggctgagaccccgccgggcctcaggaagtctccactgttaaacccagcctgcaaagcccttccctcttagggatccactccattagagttgacctgaaagctgactcctttggagtggtgcgttccattaattcatccatccaacaattgcttgctgaggacctagtatgtgtcaagacagctggagatagagcaaggcaccagtcatttcagtgttttcagatgaattccccacctattgcctgctctattcttaatcacaggggcggcccccactatgttttctggcactgttgccaactggatcatactggatttggccagtggaagcactgggcaaagcccagagggcggaaggaagggagaagttggaacctgtccctctcctgtctgttcttcagccatgattaggtctcctccatgataccacctcctctttttgtccttccaggccccagctcctttctcttgtcaacctccgggttgccctacagtgacctacttagccattccactcttctgatgctagggtaatagttccctacattaaatatactctcttgagccactttgttttcctggctgggttctgacctctacaagcattgaatctgactaaccagatccctgccctcttagaacttacattccagtgggcaggaatacaataagcaagtaagcattcaaatacatgaataagaacagttcctgatcatgttaggattatgaaggaaattagcatcgaggtggcaggatttggggatggagagctatatcagctggtaaggggatatctctgctgagatctgaagaacgcaatggatctacctttgaaaggccaggagaagagcatggcaggcagagggaacagtaggtcaaaggtctcccaggaagaactagcttggtgtgcttcaagagcctccagaagccaatgtggccaatgcatctgagcaatgggggatgtgtcaggggccaatgccatgggaaggagtttggaacttacaattgatttcatttacatttaaaaagatcactttggccaatgtatagggaattttcctcattgtttataaagagagacccttaatgcctcaccctgtccaggcatatccccatcttgaaggtctaagagagagctacccctcctaatgagtttgcacaacaagaatgggggggacaaccatagctcctaaagcatggttctgagggagaaacggtggttcccttgatatcagctctaccatgttctgaggccatggtacagaagaggtaaccattcatgtgcatgacagccctgactctaaggggcattgtgggttcctttcttaaccattctggaaggttcctggtgaaaggactgatgcacatccacatagccttgcattccaaggtgatccactggaccgtctagacttttatctctggaccctgggagttgcagacactgtatcagaacctccaaccttccccttggcctgccagaaagctgaaagtttccatgcctctgctttccagctctttctctgctacatcagagagcccctttctcatgtcctcaaagtgacaaatgtatgctgccaagcaaggctgagggaaagaaggaaatagaaatgcagtccccatcatgcattctttcccaaaatgcgactaatctggcatttaggttgtttgctcctttaatcagaatgccattaagaaatctctgccgggtttctgtacacagtttttctctaatgaagcatcaaatctctttcacaaacaatagctgtgtcacatccaagcaccctggccccagccggtgtggctgcagtctctgctaaatgtgctgcctctttcaggtctgttcctcccagaatagcccgccactgcggtactcaaatcaaagtctcgacactgtctagctccagcaacgtggacagacaaaagaaatcagaggttttcaagaagacatagtgctgtgtccctagaatttgacagaatagcttggaatatgatgtttaatgaatagcctttctagtgaacatgtttgtcctggcttcaactctgggcccaggtttgcagtggctcacccaatgggtgtacttatcatccttgacttaacccccaactagtgagctatttcctggagggtggaccttgtcagaggcagaactataatgagatgtccccagagctattagtgaataacatggcagagccctgctgagcatggtgtttgaccaggcccaggtgccatggtctctaagcatatgttcatatatacatcttggaaggcaatgcagcaacaactatcattatttaaggtgcacataacctgggacccaaaaatgccattcataggagtttaccccatagatacactggcacatgtgtgcaaagaccaatgtaagaatgcatttgctgttacattgtttattacagcacaagattagaaacaatgttacaatcagggccaggcacagtgactcacgcctgtaatcccagcactttggaaggctgaggtgggcgggtcatctgaggtcaggagttcgaggccaggcttgccaacatggtgaaaccttgtctctactaaaaatacaaaaactagccaggcctggtgccacacgcctgtaatcccctctacttgggaggctgaagcaggagaatctcttgaacccaggaggtggaggttgcagtcagccgagattgtgccactgcactccagcctggacaacagagcaagactctgtctcaaaaaaaagaaaagaaacaatctattgataaggggctcccaattacatatatttggatacaccaatgcaaagtaaaaatatgttgtagctgtttttaaaggcaggtatataggtctgatgtgaatagatcattaagaaatagtgtgaggccgggtgtggtggctcaggactgtaatcccagcactttgggaagccaaggtgggcagatcacctgaggacaggagttcaagaccagcctggccaacatggtgaaaccctgtctctactaaaaatacaaaaattagccagcaaggtggtgcatgcctataatcccagctactccagaggctgaagcaggagaatcacttgaatcccggaggcagaggttgcagtgagccgagatcatgccactgcactctagcctggacaacaagagtgaaactcggtctcaaaaaaaaaaaagagagtagtgtgaaagtgcaccatcattttttaaatgggaaaattatacatagacacgcatatatgtgtgcacatacgcttgtatgtgcatagattctcactgaaagtgtacactagagattgttaataaacagttttcaggccgggcgcggtggctcacgcctgtaatcccagcactttgggaggccgaggcgggtggatcatgaggtcaggagatcgagaccattctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccacagtccggcctgggcgacagagcgagactccgtctcaaaaaaaaaaaaaaaaaaaaaaaaaaaaaacagttttcagctctgggaaggaaaaatggggcattagaaactggggatgaagagatattttaaagtatatgatttcaaacaaattaacttttttttatttttacaagtacatacttaatctctttaaaagtaattttgtaaaagggcaaaatgcagtgctccctgaggctctggtaaataaaccgagaaatcactgactggaagttgtggtagataaaataatgaccctcaaagatgccagtatcttaatcccaagaacccatgaatatgtgaccttacatggcaaaaggggtttgctggtgtgattaagttaaggatcttgaaatggggagattgtccttgattatccaggtgggcccactgtaatcactaggtctttataaaagggaggtagagggtcagaatcagagaagaagatgtgccaacagaagcaaaagtaagaagtgatgtgaggaaggggccatggaccaaaaagtgtaggcagtctctagaggctagaaaaggaaaggaagcagagtcttcccagagccagcctccagtcctgctgacactttgactttagcccagtgagatgatttgggattctgaccccccaaatctgtaagacaataaatttatattgttgcagccactaagtttgtggtaatttgttacagcagcaacagggaactaatatggaggtaaaccttttaaaaccaactaattcatgtgtcagaagggggaccatcagccatgcttacccaagtggaggctcatcacccttgattgatcattctgctggggacaggacagattttccataacactatcagttccaatgaaagctgatgtatgaaaaacatctcccttagttggtctgatggtagcagtctcctggatagaactgccatcccagacccacactggggtgagcttggcagccatctggcctcatcactatgctcttcacagaatgctatctccactctagcatgtgtctgtctcatttatcaagctgatgacatggcggtatgaaaaaaacagatgagaggtcctacctgccgatctgctccaaagagattataaaatctaagaggaatgcctgggtgtgtgggcgggggggcggtgggggaatgtagagaagaacaaagttccttctggagctttgggaaagccgtttgtgagcctggacttcccccagcctttgaatcattaatctggttgtacccaagacatccaacagggtgcagacttgcctcattgctccagaagctgagaccacccccgtaacttgtgaggacggaggtcctaccccctgtgaagaaggctgagacacagagaaaactgagagattaaatttataatcataaccttcctctggcttccagagaactacaaaacaaggacacattcccactgtctcttgtcccaagagtagagccaaaccaaatagcctcaccatacccaacattatgcaacttgaagcccaatcaattggctccacccacatttcatctacaggacattgttgccaaacttcttaggtatcttcaatatgagatttttaaagagctaaagatataacagaaaaagcctcaatggaaattttacggctattttcttttgcggctcagggaacataagcttttatcattttccttcattcaagtaacagctttgccctagctccatggttgtcatgcatggtccatggtgctgctttgatgatttataaccagctgagtcatcatctcactaagtcaaaagagattagtatgtgaacctatttggtaaactgtaaggcactacacacgtctggtggcaaggcttgtaaagctctaaatacacgcataattaatgtgactactccccaagacagatggtataaaggagacgacctctacctatgaaaggaaggggagaagaaaagatcaaaaccacctccttctccagccaagctatgtttgctctcccattcctctccttactcccaagatctaaacatgacaggagtggagaagggaagatgtctttaatttcctggttaatttctcctgcctggattccaagatggagacccaaagggagacctgtgtgataactggccctcaaaggagtgcacacagtagacccaggagcaacagcaaaagttgctgactaaacctggggacagcaattggtatccatccctcaggcatttactttgccttttcctcaccagtcaacttcaaggcccttgaagttgtcaagaaactggcaacctagacatttatatccaaaccagatccaagaattgtatcgtaagaatggaacaataattgaaccttgtgtcccctgctaaaccagagagagcttgtcaacaaaaaggactgagagaagaatcctggggaacgggctaatgagaaaggctacctgaaccttcagaaatacctggggagcttattttatttatttatttattttgagacagaggttcactctcaacgcccaggctggagtgcagtggtgtgatctcggctcactgcaacctccacctcctgggctcaagcgattctcctgcctcagcgtcccgagtagctgggctacaggcattcaccaccacgctcagctaatctttgtacttttagcagagacagggtttcgtcatgttggccaggctcgtctcgaactcctgacctcaggtgatccacccaacttggcctcccaaagtgctgggattacaggtgtgagccaccgtgcccaaacttgcagcttattttaaatggatgtctgggctgcactgcagatctatggtgataaggcaggagggggcaccctaactgaaaaaaaaatctccagatgattccaatacccagctgagtttaggtcctaccacattaggtgacctcccaaaggtcccctcatttgatttccctcccacttccacactgaacaccagcaagtccagagagaaatggccctcggcatccagcagagttctttccagtgcccgccagagtgatggccaccaaaccttcctccagactggctcccattgtgtgcagggcaggcaggacagtctgtaagagatcatcactgtggacaatcggggaaggagctggcctgggcagagactgccctgaacattcatgggacctgcgccccagagcatcagatgggcctctctgctgaaggaataataaatatgtcttttgaacaactgattttgttgttgttgtgtttccacacatatatgttcaccagtgctggtttcatagtagttcagtcgtactgcacaggtgagctagggggctttcttaaaagccagaagactatttaaatttagatttgcatgctgaaatggagcaacttttggcatgtgataaagatggggaaagttgaagaccacaccctgcaacgccctccctgacttactactaccacccatcatctcccattaaaagaaacaaaacaaaacatcattctaatgccagttaaacgttgcatgtattgattaagccttccctcccatctgaaattctccctaaggagtaacattttaaagcttgcagtgagggtcctaaggaggctgctgctttgacagcctgcatgagcagcagaagggaccttgctccctaggccagcatctggatttcccatctggcccacgcctgcagctgcgtaaccctctggcccccctccaacgtgcctcaaaatgttatttcacattttgggtccaaatggacactttctgagaagtcggtgtaacctatcaagctttggaaacaagtttaagttgtttttgtactttccattacccaggttgttctggaacgcagctctaagaggttcagcttgccaccacgtcaaggaatttgagaaaagggaaaaacaaagagggggaaagcctgcacaagaagaccgagggtctggaaatcagaacctggtgttttccaaaggtcctgttcagcctacactccccttttccatttctgccatgctgttggggcaaactggcatgggaagtaggggcttttgtcctaaaggcatagcatcaaggtccccagagctacaaggctctccaattccttctccctggtcccgtatcatcagacaaacccaatagagtgattctctaacatgctgtgctcagaaaggtgaaagaaccaccaggcgtggtagggaggctgtgtccactgttcagcccagtcagtgtggcttctctccctgggctgggctccatcagctcatgctgagcctctgtggcattagaaaaaataatcccttggcctcagggcctgctaagggacttcaagccagatttcattcccattcacttcctaagccaggtaccctgtgcagggcatgagagccagtggacaggacgcccctgcacttgggagattcggtaccctgattaagggaaagccacctccctggctctggggaaggtaagagacctgagaaagcaacagccttggatctcactacattttgtgggctacttctgaaaaccacactttgaattccagtcccatcactgaccagctctggactacctgtgactttgaataagctattcaatctgtgcctcaactccctcccccatacaatggggaggatgttagcatctatctcacaggtagagttgttgtgaggactaggcagagtaatccatataaggcactctatcattatgttgttagatcagtttcaagaagcacattttccaacataaaatgatttgtgaaactgagatcttataatcagtccatatgttaatacatacttaatagagttttctcccaccgcatcctccaaaacagcaggtattaaatcaatggtgcatctttctcatcaacgtatttgagttaagaaaatatggtcttttaattaccatttcatgcatagtaatggctgcaatgttaaagactcacttcttcctgggtaattttgcagcatagtctctaccagcacccctggggatgtaggtgcctaccaagccaccatctcctttcttctccagcccctctggactccttcaggtgctctcaaacctaaactcataaaatccttgccagatccttagggagcatccaacaagtggttctgagcccgagctgctcacagaaatcctagggcactcgctggccccacaggttctgattccattaatggaagtgaggcccgggcatcagcatttttaaaagctccccagatggttgtaacatgcagtggaatcaagaactctggctccagtctgtccccacctccatctgatgcctgaaatcccctcaatccctgcagctaatgagtagctggccagcctcttccaggagaatcaaaacttcactgacttaggttgcagaacaccataataaagcagaggttcttcctcaggcagtgtctttgttgttctgagataaagaaaaagaccttgaaggcaattctaagctgggaaatgagaaaacctgcctcaaatggagtccttcttcccagccatcttaagctcagatacctggaatttatttattttgaactttgtagaaatcttttgacttacaaatgacctaattctctaaactagctatgctgagaatgcaagataacttttatgctggcttgattccataagaaatagtgactcataaggatcatcatcagaaataaatttctcaaaacttttaagtaaatctgtttctaggtaaacttgatggacttttgaaggattatatttcccccttctttttcctcttgcatccataccaagctcttttctttatggcagaccttgtttcctctccatcttctactttcatagatacagtccatcaaatcatacacatgactcatttcaccaaccacgaagattctaccatgcactggagaattagtgagttggcttcaactgcacttcaattgacgccccggaggtgggtaagcatacatttccacatgtatgcagatagaaaaatatctgattgggcactaaatgtttaattctctgagaaattggcaatccagtgagaaagctacgctaggcatcctagatgcttttagatcacagtaatggaagcatctcacaacagcctaatgttttcaacccatcagaaagcagagtcccagagagcctatggggactcaaaacaaacccaactaaagccaggtggagtgacctctcatctcagactccaaggcttgggagtaggaatgggcaaagtggagacaagctgccaaatattaggggtgcgccatgtcctacatgttggatgggccctttacacatgccatctcctttaacttccttctcacagtaagtggggagacagagattagaatcaggctcgcataaggtcacaaagatagtaaacagcagacctaggacttagccctggtccctctgatttccaagcttccttccaccaaatggtggagtaacttgctcccaatccatggatccagacctgggaaaggggctgcttctctgagctccaggagctattggttgagaatcctctcttttttgcatccctgggttgctgcccacccccatactgctccttaagcacttaattaatggtgtcctgtggccagtcctgatgatgcagtttttcttggtcactctgtgggccacagacttgcagctgccaattccccctacaagcattgctcgggtccaggcccactgtaggagacaccctgactactccggtgcagatctcacagctaccatgactgtttgttcagcccccacattctccagggtcccaatttcttgtcccacattcaaaaagaatgaggttatgctgccagccagtgggtgagcaaggtgaaaagttttattaactgatgaaacagctgtcagcagagaggggacgtgagaattgtctaccacccaaagtcaggtagtctctgtgtcccagtgtggctgagtccagggtttttatgggctcagaaaggggatggatactgattggtctgtgagtatgcaaaaaaaggcaacagtgtaaaaaccaattggggaagggtgggtataggtgaagaggtgggggttaatcagaggaaagcatgccaaatgggaagagaggttctcaatccagtctgtggatttatccaagacttgtagcttggctttcagactttaaactggctttggtttgcaggggggggtttcactggggactcacctgtgtttgcctagggatttgtctacctcctgctgtatcactgagttcaaatccccattctaccacttgccagctgtgtagccttgggaaaattactaacctctctggcctcagtttctccatgtttgaggtggaaataataatacctactctgctctgaacactaaatgagctcatttacgatggcatttagaagagtggacagaagtgaatgttccttctcccattattcatattgactccaccagtactgtctcacagggtcactgtatcatggcatccatctttccatgggtacatgtcttgtatagtccttaggggaaggtcttgttcttctctcctctcctcagggtccactcacttatgcattatctcataaaggatactgaagcccattgagggcatttcctaatctgaaggggcctctgatagacttctactacttaagtctcccatcactttcccacccttaaccccattctagaaaaacccataggtaaacagagtatacctgattttctaatacccattgaatattttatatttgtttttatactttgcaatgaagaatgtttcagtaaatttcctaaaggaaacaaaaaactcatagatgatataagtaagccatgtcacccctgggcttcctccaccttccactgtgtactacaggcagcacagtccctcccatgctgtgctctgaccttgcctgaccttgccaccctgagtgtgacctgcagaccagcagcatcagcatacccaggaagtcagttagaaatgtgaattcttgggccacagacttaaagactcagaatttgagcccatggattcttgcttcagggtctgtgctcttcgccaccacactacactgtttctctttatcagcaatgaaattgagaacagactcattgcaagacgctcattgtcagctccgtcctctactgacttcaaaacatcatcagcttttcacattaaatttgtttatcacccgtctcagatactatctttgatatcagaggtaagactggcattgtggacagatgttttcatgccttgacccaaaagggtaacaaacatggatactgcaggccaacacgaaggaattgtgttgatgggccataagaaccacaatgggtcccttaaaccacacctcagctacctgatttcctgcacatagggccagaaatatactaaggggaaaatggtagaagggaaaatgagaacaagaaagaatgagataccctgcaggtgtcttcctctactagggaggcccctgagaaatgactgaatgtttttagcaaaagattagaagaataatattatcttgccatctgttattgcttatagagagccaataagtgtgtcttagagattctgagttccagggatgatcccactcaggttccctgacccactgtgagtcatacctccatagcagaggggcccctaaccccaggatttccatgccttctgcaagctggtcttttagatttcatcagcagtcagtcctgtggccatggaacggggaatgatcgatgacagcccactgaaggaggaccttcttcttgtttgcttggttctggggaatgcatctcctaggcaggagcaacacgtgccataatggtaaaataatttgggaaaaaatggcaaaaaatatttgcttttgccttaaatctaccaaaagtggatcacaggttgaaaactgcctgatcttggtcgttcgaagcccctgagtggctcagtatttgaactcagtgcagccctgagcaaccaattaatatttgcccagtgggcaggattgacttcagttacctaaagatgttactactgctcttctggttgcccagagattcccacaccccgtgtgcagcacagatccagcagagactccttgccaaaggccattgcggtccaagaccccaaagaggaaggctccagaggtgactgctgcttgggaagtcaatatcggacatgagtgctagaaccaaggtaatgcttcccagacttcactatgcccaccagagacctggagagcttgttaaaattttgactgctgggccaagagagctggggctgaacctgagaatctacatttctaacaagtctccaggggatggtggtcgatggaccacactgagaagcaccatgtctgaaaatcttttgagccaaacattttatttcaccaatgaagaatttgggaccagagaggctaactagtatgtccaaaatcacccagcacatcagtgacagggttgggaccaggtgccctgactcctagtttccactgtgttcccactctatcagcttaccttaaaacagcaatcgtcatagtcattttatgaactataactcattttgagtaccaaatgcttttcctatttcctcttctttatctttataatcaccctttgaggttgagggcatgggtctcaacttatagagaaagaaacgaaggttgaaaaaagtaacaacaacaatgaaaattggctctagatcacaagccaaggagtagagctggattctacccagttctctctgaccttgtgctgttcctctttacatctcttcaggttctcagaggggagctctctctaccaaaggtttaatgcaagacccacatagtcacctagcttacggaaaggacaggcctgaagactagggtaaaattaagatgataaaacagtgaacaaatattttaaaactatgtccaggaggaaagctagaggaaagagccctaagccccagctgctccataggctacctgtcattctctttccaaaacctttcaggggtttaagacctagaaccacgtgtctgacaccacagccctgtaaattctgtccccaagagtcctgaggctctgcgcaaacaaaattaatagcctgcaaactctaaatgggtgattacaatctataaagcagcccataaaatgacatcatggggattcatatttattttctcccactgatttccactataaatttgcttggtttatgagtagaaacagtttcttctgctacgtgcctgggcataaagctcacctaaagatggaaacctaaagatgtctggggctcacttcacccccagtggtgctctggtcaatgggacacacagaagaaacctcccaaggaagctctggaaaccccaaagcagccactgcctctacaaacatgccctgagagcctgctgagctgcaggcttctgtgctaggtcttgagcagtagccaacaaaatgggggtggtctctgccctcagggaccttgcaagggtccctgaaagggaaagaggagacagacactaaacagaaaactacatggataacacatgggggttcattagggaatgcaaagggaaagtacagcaagctatgagctgtggaacaggagcagctaacctgatctggtaggggtgatgcccaagaaggatgagtaagtggaggctaagcaaaaggtggggaaagggagaagaggagagacattccaagtagagggatccacatgggtagagcccagctgtttgctgctgttgcagttgagccacatgagtatcaaataaagaatgacaaaaattctgggtcagacaacacatataggatataataagattaggttttcttccaagtgcaatagaaataaatgaagagttttaagaaaagaattaacatgatcagaaaaccatcttagaaagattctaccagccgcagttagaagaatggatttgacagagagggggtgtttaggagggaatgtcagcagatttgtaggacactattgcagttgtctacacaagaagtgatggtggcctgaactaggtaagaataaatgggccacagtgctatctaggaggtaggaccgattagggctgtcagacccagcttacgcaaaaagggcagggcatttaggaggtgcacagtagataatggtgatcactgacctactggcacttgcaaatgctttgaatccaatctcattagccaaggtcaatacctggaagccactcagaagccagtattggtacgaggtcaagtgaccacctcaccagtgcaacatagcacacgcagctcaagtcatccccagaccagttgacactctcaacttgcaaaagaacacatgaggtagaatccctttcctttaatttaacccaagctctactactgcctcagttcaaaggtcatcaattgcaagatcagcagaaggggcatggctccctgaatcccaacaaggctacaagggttttggttttacatagctcatccaaagccagtctcttctggccttcagaaatttctccctcttccaagctccaagggcatttatatcatccctgtacatgcagacacagtccccaacttacaatggctcaacttatgattttttgagtttacaatactccaaaagcaatgggtattcagaagaagctgtacttcaagtacccatacgaccattttgtttcctactttaagtgcaatattcaataaattacatgcaatgttcaacgcttatcacaaaataggtgttgggttagataattttgcccaactatgagctaatgtaagtgttctgagcacatttaaggtttaaggctaggctaagccatgatgttcagtagatggagtctcgttccgtcacccaggctggagtgcagtggcgcgatcttggctcactgcaagctccacctcccaggttcaggccattctcctgcctcagcctcccaagtagctgggactacaggcgcgcaccaccacgcccagctaatttttttgtatttttttagtagagacggggtttcaccgtgttagccaggatggtctcgatctcctgacctcgtgatccaccctcctcggcctcccaaagggctgggattacaggcatgagccactgcacccggcctaaacacatttttaacttatgatattttcaacttatgatgggctatcaggatgtaacaccattgtacgttgagaagcatctcattctaccttgcttagattcaatttggaatcacaacttaggctgccattgttgtctaataattgcatgttcattaacctgttttccaaaaagactttaagccaccttaagataagcacagcatacccagcgacaaggtgctgtagatgagcacctactaaatatcagagaaagaagtgaattgactgggcccagaagagaggaaaatgccagtctggtgatgccagaccaacagagaggagtgagtgggaggacaggctcagcactgaactatctagagttgcccttgagtcctagccaagatggctgtcactccccaggtgcccagagatggtggctttcttgagcaattgatctgaaaataggtcccctaagcagaccttgtcactgaagttcacacactgcccaagctgagtgccatgctgagcatagcccagatgaaatgattgctcatcttgagggcaacatcccagacaaaccagtcccttttatgtctcactcactatggagggaaagcccctgctctcttgccctcaaacattagatgggcttacagaaatgcattcccatttcataatgcctgctgtgattccaggtaattcctctaagtgcactattaaatcccagcagctgttccagataacagcaaagtcgacaattccagctgccgccttgtcaggaaatgaagcaaagcagctgtaagtttcctaacactgagacatgaccaaaatggcagcatgagggatcactcatgtgcaggtttctccaccgccatgcagataatgtgtgtccaccatcacacatacattacctgccctgagtctactctgatgtctgaggctggaggactcaaaactgtgggccatattcccctgagatacccagctacagttatctttgagatcctcatgagaaagaatcccaaattaacactgagcccctacccataaagcatgctcaaggtgctggagaattgcttaaggccacacagctaaaatggccgccaagtcaggatttgaactctgatcctgtgagctccaaagcatcaagcttctctatccttcactgttccctactgctcttaaagccctgtatttcccttacccaaaggagcccggccatctcaacagtattttcgccatctgggccaaccacgtgccggcagagtgcataaataccacttttgtgaccaaaactgtatttcctcggttgatccaacatcagcatctttgcacctgcaactttccttaagaagaatttttccatgatgtgatgacagaatttgcagccagcaaaggggatcatagacatacatgtacacacgagcccacaaccatctacttcaaagcctcccagcctgaagtacgctctccagatgtctctatataccaggtgcttcgaggctggccagcatctccctgacagcagaacaagttagtataaggaatttctatttaaaagccaagttctacaaaagctaagccaagcaaggttctaataaacagtaaaaccgccacgttgtgacacatggcttaaagttggtcactcacctaggtgggtcagaaagacaccaatgcttttcattttccccagcacctcaaccctggttagtgctagggtgggatccctggtgggagactccacccacactgaacctggctggcttcacttttccagactggtgtgttctccaggcaaatatatattttccccctacccacctccctccgtgtgactcagcaagcaagtgctgggtaggaggagtgctggtagggtgggggacgactctgttctcattccaggctcaaggaacagcctcagtcatggacaagaagtataggcagagagtcaggagaccaaggctctagacctgttgttgatgactaagatggcctgggatgagtcccacagcctctctggtctcagttcctcatctataatttgcaggttgaatgatacctgaggctctgtgattgcttgagtcagccaacagctcaatcagccacacagaaacaacctctcctcttctctcttccagcctggataaagcttgtggggcatgagatttatgggtttggtgctgaattgcatcatgtatgaggcagaatttgagttggattttcatgggttgggaggatttgtaaaggcattgaaggcatggggggacatgagtggcataaacaaagaagtggagtcaggaatgtgcttagcgtctttgaaggaaccactagggatgataatttagacagcgtgcactagtacaactaaaccagtctctcaaatattgaaaccttttgtaccggctggtaaacagccaatggccttgacttaggagtgccccctcagctgcccctgctgctgcagtgcctatcccccatcccaaccccatgatccaacaaccaaagggttaatttctgagatctcgatccaaaaggtgcccataccatggtgatcctagtcagcccaaagccacaccacacatctaacaagcattcctgtgtgccagataccatcttaggcacattaacatatgttactttttctccccttcacactaacctcttcagattaaggaactgaggcttggagcagttatgtgacttgttcaaggatgcaataacagtatttgaacaaagaccattaaatccaagtccagagctcacttcttaaaaccccagctgcctctgagcagccttggcccgcagacagacgagctttggaggaaataggaggaatttctccctgctatggagattgttttaagatcatgaattgttagcggaacaagttgtcgtggcagcttatgaaatcaccctcttctgcgatttttataagtaagaggggttagaataggcccagagacagagggagagatgaaatgacctaataaaaccctttccaaccctggaacacttcagccccacatgaacagaaaagtctatttattttcaaagccccattttaactcctgaagtacttaggagacttaaatatgtctgaaggcaaaacaagttccctctttttcctcttttcctaccactccaactcttcattgcagattttcttcctgcaggtctgacaaacaccatttttggccacagctgctgtcagttcaaaagtttggctctggggtctgaagaccaaagtctgtccaaggctgatcaccttctgagaaagactcttaaattctgtgaagagtctccagcagaggagaaattggtttaaaaaagcaagaagaatcaccacaatgcatgcccactccacattaccaagcctgcacaactcatgttaggggatgtctgctgctcctccagctttctcccctggcaaatacagtggtggtccctgagtccccattagggcccaacagcaggaccagtagcagcccctgtcagagaaaccacagccagttggggagagcgaactcatactataggcttgtttccatggcaacagatgctccctcctccctgcttctcggcaccagggaaggacaaggaaacccatgagaagacagtggcaactagggggaggaggaatggcagcaagtcccctttctttgaaacccaggcagctgctgccccacatgttgatggttacagctctcagtgaccttggacaagttatgccccagctctgaactttgtttttatcatttaaaaaaataaataaataaaaaagatcaagagattgagagagagagcaagcgagctgggccagagatgatccaataaagctatttcagctctgatgtcccagaatccaatgatttgtctaacctggccagtgattgggaatgggttcacctcttcttgcagccctctgcaggagcatgacattccgcaaggctggagtggatctgcctctcagggacctaagccttatccattcccccagtcatgctgcctccctcacaatggtctgctgtcatttctctgaaatcatctcaggagatctatcccatgctttcctaagggtgcacgggtttcctggggctcacacaagccatccaacatgacaggtgagccagaatgtcatggcaccgcacccagccacttgcctcccacctcactgatgttgttggattcaacctgcaattcagatgcacacagcccactaggcgctagcctgctatgactgcgcaagcgaaggaactccagggagaacacccagaaaggtcattttgtttggtatgaagagtgctagggtgaggtgaggggcagggagtgggacagaagcttcccaggaaaaggggaaaccatgcacagcagccaggagccatggactccaataccccaaggtttggaaaagtacttgtaattttggctgattgaccaaaagtggaaagaggagtgtagcatgagagaagggaagagaggaaggacagaaaagtggacaaagaattccaggagatggccggccgcggtggctcatgcccgtaatcccagcactttgggaggccaaggcaggcggatcacctgaggtcaggagttcgagaccagcctggccaacatggtgaaaccccatctctactaaagatacaaaaaataactgggaatggtgatgcacatttgtaatcccagctacttgggaggctgagagaggaggactgcttgaacttgggagacggagattgtagtgagctgaaatcgtgacactgcactccagtttgggcaacagagcgagattctgtctcaaaaaataaagaatgccaagaggcataaaaacacggcaatgcttccagggctggatttaggggagaaaagggagtactcattgttggaagtacaagccacatgcccagtgctagcttttatgggagtagcaggggatagctgagggccaggttagtcactgagccctccacatgagcctggtgggggtgtacttgtttccattgtatgcatgaagaagcagcaactcagaactacagcatgatttcacctagtaggtcagctaccccttttctggagtatacaatcttgctgggggacaaaataaacaatcatggacaaattaccacatgatttaaaaattgacacacggccactctcacaaccatcctcagaaatccagaagttcagggaggaacaacaacaaattggacttctgaggacttcctgttgccagtggactttaagaaacgttcagcctctccagcgcaattcacccctaacctatcagactccgcgttggtctgtgatggctcatctctggctcggaaatggttaaacagttcatttctgtgcttgaatcaggagcttccttaaacgctagcataaagctggtctacacataagaaatctgattagctcccagcattgggcaatcccaattattatgccctgcaagttgctctgcaggattagcggtctgcggaagaaaggaatcaatatacaacagtaattagggctcctgatgccggtaagaggagcacttctcttccccttaagccactcacgacagagtccatgaggggacagggccttcacagcactgccagtctctgttttctagcatatgttcattttgactttggtttttatttactgaaggatgtgaaattctctgctactgggccaagactttagggctacatacgtcacccaagaacagcgaacaggatgtgtcatgcatgggaccttccttccaaggaaactcagggaaagcagatgctaggatcctggcaaccccaggaaacctaatcagtgtccctgtaaccaagagctctttgagaacaggggctgtgtcttatttaccttatatcaatgtggcctagcacagtacctggcacatggtaagtaatgaacgggatggatgaggaagtgaatcaatgagtaagtgaattaataacacatggttttcagtttgtcaaaaactttatctgtgagcctgctgtgcacagaattttgtaccctaatactgtagtagcaatttacattggactcacaggatttgggggttaaagggaatttgaatataacccaatctggtatttttaaaatcacaggttgcaacctattagtggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggtgagtacaggaaaattaggcttgtacttgcagggcatgagtgtgtgtctattgggtgtacagtgtcttaaggccaaaagccactgatgaatctaaccattcatccagtgattttcactgccctcagaggccacatcagggacaaataattttcctttttgatcccctcttgttacaggaaatgaatttcatccagaagcagcctgtttcacttacagactgtctggctgcaggaattagggcaaatcagagatgttatagaaagaaaaagaaaatgtttcctagatcaaaacacccatctaagtgctggggccatagagatgagatcgattccattttccacatgacaaacattcaaagattttagaatgtcaattgcgcccctgctgaatggcttggagaagagcaggaatagttctagttatcctaacaattgctcctaagatgttgctttgtacctgctcgttatccatcttgattgtgtttatgtaagttccagcccattcatgacccctggtgtgtggcatgaagaccatcacatttgagtctggtctgaagcttgtctgggtgatggctgaggtgaacccatgttagctcctggtgctcaccaactctcttcctaaaagctctcacattatctgttcaaaagcctgcatccacctagcagggtaatttcatcatccctgccctctcgtctgtgaataaacagcttgaactaatagtatttttcaaatgtttttgaccacaaccctcaggaagaaatgtactttacaacatggttcagaagacaccaccacacccccaacacacacacacacacacacacacacacacacacacacacacacgaagcaatgtttacctttactatatataatgggatgtactatgatgttttattctattctgcttcatttcttatgatgttggtgatgacccattaaatagatttcacaagctactgatggaccatgacccacagtgacactgaactagatagtacctaataatctgaaaaggcagggaagggcatctgggaagaatttcacaccaagcccatttcttttcattatgtttatttagccatgtgcctacgtttggttgtgtgtaaaggaagacaatggcttagtgagctgcagccaggctgttttggggactcacaaaggaatggtcacagtttcctgcctgtctcttattgccccccaggcaagctcattgagaaaagacagtgtgagtctcgtacagagcatgctgataactattacagatacgtgattattctcggttctgttgatgataacaacatagctgccatcttgtgtttgtttcctcttaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacatggttcattaaataataaagtcttcatcaggctctcctgcactgggctgcaattcttttcccccacaccaccaaagaagtgctgcctttattagaatgcagtgccacccattggcagtgggataatcaggggatttgtttttatgtgacattctattaaccaaacatcataaactgcatcaagtaaaagccactgcattttccccagtggaggatcccatcaccacataatcattctagactgtgggttctctgtgggcagggaccacatcccttcatctttatattcccagtgctaagcaaagtactcagcattggtgggcgcaagataaacatctattgaattaagaggaaaatatctccagtgtgggattcagaagagcaatgcttagaaacctggaggctccctggttgcaatgagcatttagtgtcttgaatactgtgtccctttcctttctggtttattaattttccacttgactggaccaaattttccaagtccacgtgatagcagacaggactctcaaaatcccctctggccaacagaaggttcaacaacaccaattttgctgtcttcaagctcaggagccctgctgggcagcagggaacctgtgccaatctcagtcttcctaaagaatcccacagttaaaagaggccacctgaaaatgggctgctgagaggtaacgatgaccttggaaatgtcctcaggtttgggaagtcagcaatttggtttacaaagcatgaaaaggaagactcgttgtaaaatacagaagatttaccagcttaagtagtttagaccaactcaaacttgagcttgagcctgcacgggactctcctggagggattgttcaagcacagagggttggcttcaccctcagagtttctgattcaggaatctgcacctctaagatccaggtaacgctgctcctccaggcaccccactttgagaagcattggtttagcctgcttattacaagcaaggctctagagctggctatctatgctggaaccctgaacccaccacctcagccaataattttaggcaagtcatttaaactttcccatccccaagatgcaagtgtcaaaccaaagcaccaagaggatctttctcacgagattgttatgaaggtcaaaggaggacacccactgcttaggggtgtgcttggtaggtagaaagagcttaattaaagttaaccacataaaggaaagtagggatatggtctgggggaaagactgctggtcagagaagccagatatgcattctagctctagccctgcgaccctgacttgctgtgtgaccctggacaagtgacttctttctgggtcatgccctcattcataaaatggggacactggacattctataatggactgaaggtgccttggcgctagaagcttccaaagctccttgctcctgactctatcacacagcgtcacgtacctgtagtgccttcccaatcaccccctaccacttagactgccaactgccaggccccagcaggataactcaagactgccttgaagacattgtctggttccttggccttgaagggtctttccacttggccacaggtgaccacctgactcaccgaatgtagtctaaggaacccacttccacctgggaagtgcaacctgggatccttcttgctgaaaccctattgcactccaccaagattttgttcacgtttcatttgtagccagctccactcatgcctctcattgatattcttttgtggttacattccagactggaagataagggaattcattgaagtgtttagaagggacaagtgtggtttcatcgggagtgttatgctcagatgagtattggaggattagttggggagagaatccacactcgcagagggagatgaggttctgaaatttattatcatagcctggttgtggggaagggagcctcaggaggagggttggaagcccaaattcctaattgaagatgcgaagcccattttcatcttatatttttattagccccatagcagcccactgcactggctttctgctaacagccgatggcagggagaggatgcttgttggcacaaggccgctgtacatttcatttttgtcagatgctggcaaaatttcctcatcagggaagataaattcgaggtgatattaataaacctctgaatgcagcaatcagatctggctggcactcttaatgattccaccagcagtgagccatttccagcctgaggagcttagagattcacggttttgtttaaggcatcccaaaaactagaaattgtttgcttgactcctgggttgagcccgcatcttcaacctggatactcccaggtgccccaagtgaggcagtagtgatggaagagaggcatttacaaaataaagtcttgggtaaatgttactcactattgttttgtacccagaaagtgctaagtgtctcatactatctcgtgtaattaccataggctcagtgatggaggtactatttttaggtgaggtcactccaacttagaaaggttatcattaacaatattggcatcatcatattgcaatattgactgacactaagtgctttctatgtgactgagcttaggattttacctgcattttcacttttcatttgcacaacaagttatcaattaagcactgtgatcgccaatttacagagttgaaaatagaggcttagagaggttaaacgtgaggctcaagatcagactcaagatgcatagccagtgatggaatccatgtgtgttggattctgaagctcatgccgccatggactgtgcttgttacggctcacaccaccatggactctactgtggaggcacaaccagagggccccatgggtctccacttgtagaaggcggttcacctatcatcctaccttctagtatgaaagcagcttgcactcataggcaagcttacagaagggtgcagccccagctcttgacatagaaccaagcacctggtaggcaccctttcaatgtttgataaataaatgaattgatggtcagtccctactcacgtcctagaagatttgtgaaaggacagttgaaattagtctcctatgctgctgtccacctcttggtatcttggtggacctattcaccaagggccaaatgtccctaagcacaggtgagaagagttgaggaaggtttttgtatcctactctgagagcagttggagacttcgttccttggcttagaagtcaagattggatgcagaactaggcaagttgcttttctgagcaaagagagtgctggcccaccccacatcctcccctggctgctggcccgctgcaagccttggcacacaagagaaggaggcagaagtgcatttgtttattcattcacccacaaacatgcctcaagcaattgagcacctactgaggccagagtagttttgggctctgcggagaacatacatataaataagaaaccatccttgaccttgaggaatttataagctaggaggaaaaataacaggtacattaactcaggtgtcagctgtctctggcttctccagtgcctaggcccatgtatacagcatcttgttttgccctgaataactttcatcctgaaggttacacttttttgagcttctccctcttgtccctcatcccaccccatcaccaccccatgccattgctccagatacaagcaaaaaggaacaacacagactgttgaagatttcacaggtaaggcagaaaaggaatttaaatcacatatctcatggcaaatgctctaacagattttgagtttgccttagttccttccaggccaaagcacaaccaaggatttccttccctgaccttttcccacagagttccttgaggtagaaaggtggctccaagaagcccaagtccttcactcgccctccaaaagcctcaccttttcactagagcagtcttcaccccttgtagatgtcattaaggatattcacaaatactcctattacgtcctctttctgggcaattgtaggattgcactttctagtttcctaaagttaagtgtggctgagtgctgagtggtttgctctagccaatgtaacatgagccacatgatgcgtgacacttctggatggaagctcttagccagagcagttcaccactgcctcctgccaagacggtgctggaagcaaagaccaagaggaagtttccatcaatctggtttgctgagtgactctgatgaacagcctccaccctcctactggcctcctaccttcatgactgatatatactgtattgagcaagaaataaacctttcttgtgttatgccactgtgggggctgtctgttactgtagcagagcatggcctcacttgactgatactgccctcttcgaagcagaacaattctgctttgctctgacctacagtcagactttcacactaaaccaaggtgggcactcaccaaacaaaagattctccaggtaacacaatctacactctgtggatggaaagttatggcatcttttgatggtggagcattttccttgaggtcttaccccttactccatgagactcatcaacatattttttctaaacaaaatggtggagaagaattctggggaaagaattctggggaaagagtgtctggcacaaaagaaatatgctctgggaagtgcatgaaaaaggtaagtgtcaaaacagtggagacacaggaaatagtagcattaatttggacataagatgtcttcaagaagaaagtgaagtcccccaaactttcatgcaggtttctctgcaaggaaggaaggggctactcccctaagaacctaattggaatgtggctctgggtgccaaagctgaggctgagaccctaggcacactcaaagaaggaagagggagcttctgtggctctcggtgctctgcttctctgggtcaaacccttcttgccacacaggtgtgggagcctgagcaggccagtccactcctgccctcctttcagcccactccctgggccaggatgcacacaggtatgtattccccaatttgagccctgcctcacttcttcctcgttgttacctgccagcaccaccacacttgagaacagcagacacattgaactaaatatgatatgatgtaactctagcctaggagttacagaaaaaaacccaagcacatttctaaaatattcgagaatcctgtgttgaatgttaaagaaaccaaccacataggatctttataacacaccaaggcaggcactcacggcctgtcctgaacaaatccaaatcttttatccctggaacctacgtcattgtccacctccaggaatctgtgctgttgagctgacggctcctccactacaatgttctgctcattcaagactctgtcctcagtggttcatctccctcattcacatcccccatcaaaatatgtctgacttgtatcctattctttcagggcctttctaagaaaattccaaatgtactctagcagcttaatattttgccttccctaggcaagatgtttatatttaatcaaacaacttctgggaatgatgtatgtttagtgtaaagatatgcattactcagagtggaaattttcagtatgcaacagatcataatggacagaaggctctttgtggagtccgtggcttcaccctacatgccattctataatatataccacatgtgccaaataaatcccctaaatacagctccaaaaataacatatcagtatccattctcaagtaagcgacttctgccatacccagaggagaaagcatcagattaggtaactctgcttagtggtaacattctctaaagatgaaagcacttttcccactgacagaagcatggctccaagaagcccaagtcctgaggatattgtcagtaaaaccacacacacaggtcacagcttgttattaatcaattaattctcagcttgctttgtcccaagtcatccagcagacagaacaagaagagatttacaagctgtgtgcatttaaattaatatttttaaatggcatgagtgtgcaattaatactttcgaagaacatgtccacaccagatcaggcagtgtcggtttttttttcccctgtccatatgagtctatttttaattcctttcttggggaaagacaacagtcctagatttgttttgttttgtgtttttcttctgagactcaaaataaccatgttctttctgcttcagtaaatcattactgcagcttgaaagggttcctagaaagttctagttccattcagtttttaggaggaaaagcaacccaaacacgccaagaactagaagctttatccacaagggagtacgcttcaggatgataccaactgcattaatcaggatagacaaggttatgctgcagtaacaactaaaacctaaaattccaaaggcataacacttaaacatttacttctcactcaggaaaagtcactttgggtctggtgactctccaacacagcttcctttaaagagatgactcagggattcaagctgattgtatcttgtggtctacaatctcaatgcatggcctctgcaatcaccatgaaaggccaagggagagcatggagaagcaggtagaggcattttactgactcggactaggagggacatatattatttctgtgcacaatccactcaacaacaaggggccttggaagcatgggagagtccacaagtatttgatggttattaaatctctctttacacgggttatctcatagtgatgttaagagacttcatgatgttgttactctacttagaaactcttggatttcagcccttgaagaccatgctccaacttcatcatcaaatcctcaccagaaaagacaagaggatacagaacactgagcaactcacaagatgtgtgctgcagatgtgtttatcagaactcaaaagtttcctctcttttctctgtcctatgactattccaggagtgccagacagaactagttcttacgctctgcgaagaaaagagtggactggaggtgggtcacattgacattttggtaagagccctactccttagaaacagaatgaaagttgtcaatgaggggaagggagtaaggactggctaagagtagccatgctgggaagatttcattgcaaattttcctctacctgggagctggcagataaaccagatcattgttcccaaacactggaaggaggaccgactgttaaaaaaaaaatacccatgctggagcctaaatactctatgctagagcctggctattgacatattagcaagcatccctgggcaatccaatgcacagtcatattttgcagtcattgcactaaaggaatatccaaggtccccaccaacactaggatttcacaatttatgagcattttgaaagaatttacccctgaggattgacttattcagcatttaaatgggaactaagaccacgtaattgactgggaccaaaccaagatcagaattcataacctcacagctgttcctcatgtcaactctttctattctaacacactgccatcctcattttaaaaaagggaatgtggccttgatattcccatagattgctggatgcatacttccctgtcaccttccagtagggacacaggcattctattagctcagcagaatacagggctcccatccacatctgatggaaggcaaaggagatgaaactggtctccatgttgaggacagactggtacattaaagaagcaataggtcccctcatttgtacaccaagactcaagagttgaatctttcctttagtgacaagtggaagtccatggaagaatatttacaggcatggaagagtgagtttgaagtggggggcaaattctaaagagtaaagcctttaccaatggtaaactgtgccctttctatccatgccagcttgggaacccagttgagagtctgaaggagcaggacttagctttggacctgtgagatttcctctgtccccatcccaactgtgctcaggcccatcactttgcaggagcataattttatggcaagaggttcaccacatacctattgagctgcaagaggagtgatatcaatgtgcatatagttagggagagcaaagagtgctaatttagtaactgaagataagttacattgtatatgagatgtatttatatgcattttctacttctctctcctgcctcctgtatcactataaaccctagcagtcaagttccatgtcaggcctgttggatctttttcctgccatagagggagggacctgggagatggggagggattcagggatgacagtgttccagagtttgaactgggcataaagatatagaaccatccactggccaaggctgtcataggtaaatcctgcctggaggcaatttctagacagaacattctgtgagcttctaaatgatcctgaggtcggtatgcagatgctgacttaccagatctaatttgggaaaaagaagagggtaagaagttatatcttctgtggggattctggtggtaaggatgggcacagaagcaaaagagtgtttcctccttctccagaacatctggcttcattgcaagccactgtgggctactggagtagatggagagcagacagcatggcaccaactgaacactgtgcccactctccagacctgtccatgcaacccacagtagtggagtggccactccagggtcaggtagatatggcttccttcccagctctgccaattcccagctgaaaacattcttaaacttttccagtgtcctgtaaaatgggaaaaccagacctgtcccattgtatcctagtgagaattacatgatgtcatgccattaaagtacccagtaccaagcctggtacattataaacatccaagagcctaggtcttagcttcttcacctagcatgacacctctcccacccagcttactataccactgtgagatgataaaagcacacaagccctgtcaatgctaaaatatttatgaagctatagagaatatttttttaaattttcaacctgaatgtctgatttttttcttctgtatagagacagggtatcactatgctgcccagactggactcaaactcccataattctccaaccttagcctccagagtagctgggtgccaccatgcccagcttgtgtaagagcttttctgtcacgttctcagcattcctagatgcatgcatcaggacttcaattcatgcttcttcttgcctacaagtgggttctgttggtagctggaaagccaggctatggtggaggcaacagaaggaatacaggggtcccctttccaaacctccaagttatctgggttgggatactacaattttaagagtatcaaggaaggagctggagagaggaacttctggacactcagtatagctctagactctctctctctctctctctctctctctctctgtgtgtgtgtgtgtgtgtgtgtgtgtgtgtgtgtgtgtgtcagagaaagagagtgagattgattttttattttgaactgactaggtgccaccccttcattaccatgctgatttaaactgtcaagactgcagcctggcctgaccactgaggagcaaagacaataggaaaacagaaggcgactcaggatgcaaatgcctcattgttacagaacaataaacagattcacccttttgctaaatgtcaggttaatatcctcttggcaccagctgtgcctctcccctccttccctgccacagtgagtccaggctcctggaagtctgcccttcaccagccacctaggctcagcactgggcgtcgaggagagcaggtgtggctggcacagtaaatgcaaacacaaccagtccaaccgcaaagtggaatcagcctttgcatggagtgatatcctgggacagcctcaagctctgactttggggagctctgggctttgggctacagcttgggtagctgactaagccaggggatggcactaacacatgttctccgtgtacttactcacaagccaagaacaggtaggcaaggagggaggatgaccttcaaggccagttaccaacaggctccaaatgcatttcccatggatgcccactgggcccatccccattcctccctccaccaagtccctatccattctaacttctcatgatcgcttctttctgccttatctctgcattgacattgacactgttgttgctggggggctttgctgtgcttgcctctgctgccccaacaggtctccttgtcgccataccattctccacagtatctgcagagtctccccagttagatgatctggccaggtcactccttaactcagaatacttctgtagctccctctggcttttaatgtaaagccaaacccttagcaagccactgaggaatgagtttgaccccattcctctgaactcacatggtcctttgagtttaccctttgcccaacccttattatccaggatgggggttgactgttttggtttcttcccccccatttctaaggacaggaaccatgcctcttacctctgcacaccctgtgccttacatggggtatggaacaggaaatgtgctcagtagtgattggaagccattcattccttactcagacctctctacaaattgtccctgagtctaacccacaacttccctcactgcaaaaatccttcagattgctcctgacaggactgtcttcctcatctcatctgttttctctgtcctaatcactctctggagcttagctcaggttcccccacaagtctcaccaccatgaagcctctacactgttttgtcttctctaactgcatcccccacgtggaacttcataacggtaggctttgtaatagttactttacacctctgaacctcatctacaaggatggttcacaatagatttgccataaattttaaattatgatgcaatataaataaagcacatagcacagaatctggcacacagtaagtgctgaaaatagatttgtctgatggtgaggacgagcgtggtggtggtggtggtggtggtgacagtgataatgatgatgatatctctgttttatattgcaagacccagaatgtcaattccttctttgagggaaagggccactgcttatagtggtcttgacaaacttcaaaacatatggcccaatgcttatttctggtggaagctttactgaccatattaatgctattgataatattttcatgttattggtattaatcacgttaccagggaaagagcattggattcaaagtcaaatgcagactttcagtcctgtttttccactttgggcctcagcttccttagctataaataaatgagttttccagagttttccagaatgatctgtagtcctttctagcaatgataattacgtggttattagtgagactagtccacaccaaagtgagcctacactccatccatatgggtcatccctccccagtatacctgggccccaaaatgcaagcacaccatggggaaatggaagaaattgggacttatgtcatccaaccaacagaacgccagtcctcacttcaacacacaaatgttttctgttttaaaatctactccagcagcactacaattggcattccccctcctagcagtgggttagcagcagatgttacagcaaaatgatccagactgggggtgattattaacccttctgcacagcatacccatttttgcttctgggtccacacttgcacacctaagacaagttcacccgccatccctgtcatcaagagcttcaccaccttcttgtctagacaagcttgaatcccaagcagaagaggagactgagcaccatatctttgctgctgtttttgttgttattgttgttgttgttgtttgagatggagtctcgctctgtcacacccaggctggaatgcagtggtgcaatctcagctcactgcaacctctgcctcctgggttcaagcgattctcctacctcagcctcctaggtagctgagattacaggtgcccaccatcacatcctgctaatgttttatatttttagtagagatggggtttcaccatattagccaggctggtctcgaactcttgacctcaggtgatctgcctgcctcagcctctcaaagtgctaggattacaggtgtgagccacctcgcctgaccagtatcaaatcttatcaagtatcaaccacatcctcctataaggtgagaaaccagaccccactgtaaggtaggactgcccacaatggtgtaaagagccatctgggaaataaatagtaaatagcccactgcaaaaaaaaaaagtttcaagacagacaaacctggcttctctatgtatagtctgtgcgatcttaggtaagccacttaaatgctctctcagtttcctctactataaagtggggatttttatgtcaacacaaccccaggaaataggctttgagtataataatattcacaaagcacacaaataggcactctgaagaggtcagcccctccctttccaccctgaggaccttgtgggagtgcacacaacgtgacctcaaggtaaagtgggactctgctccactgtttatgacataactgggttgtcttgcacattttaaatatctgtctgtgtctcattttcttcatctaaaactattcatatccccaagatttgttgttgggaattaaacaaaacaatacatgcaaaacagtacttggcgcacagtaagcactcaataaatatgtaattgtcatcacccatgttatcattatcatttaatgatgctgaagaacaagtaagtgcttatcacttcctttaaatcttggcaccaaccacactaaaatctcaggcaggcaggtcaaactgcaagtcagagggccagtactgtcaagtcccaacgaggccacaggaccagttacccatccgcagattatccttggaaaatgtttaaagcatcatccactctgatgtcagcaggtgtgtgctcaggcagtgctagtgtgacatcctataaaagtcagaaaaaaggcctcaaagaagataacctgagccaagaacacaggcgtagcttaactaaaatgtttgtctactcagacaccttggcccctgtccgtggtcctgaaagagacaagtggacaaagactgacgggtggtcatgacttttctttttcccttttgcaaatagttgaagacctcttctgatgcaaatggtatcaacaaaagataacagaagaaaacatatatgggaggtcatgacttctgagacatttccaaggagaaaacagaaagactcttcgacatcaagttcaaataaacaaaattattgagaataaatatatatctatattttttgtttttgtttttgttttattttgtttttttaagatggagtcttgcactgtcacccaggctggagtgcagtggcatgatctcggctcactgcaagcttcacctcctcagttcatgccattctcctgcctcagcctcccgagtagctgggactacaggcgcctgccaccatgcccggctaattttttgtatttttagtatggacagggtttcaccatgttaaccaggatggtctcgatctcctgaccttgtgatccccctgcctcggcctcccaaagtgctggaattacaggtgtgagccactgcgcccggtcaatatatatctatatttttagtcattgggcttccccacctcttataccctgactctaaaatcatcaaaaaacccttcataatgcataccagaaataacacaaatcacttgtgtggtctttggctactgctatggtctgaatgttttgtcccctcaaaatccatatattgaaatcctgtcatccaatgtgatattaggaggcaaagcctttggaagctaactaggtcatgagaaggatctctcatgaatgagactactgtctttaaaaaagagattccagagggccctcttgtttcttctgccaggtgaggacacagtcagaggactgccatctatgaaccagaaagcaggccatcaccaggcatggcatcagttagcaccttgatcttggattgcccagttttcagaactgtaaaaagtgtttttgtgtcaaccacacagtctaggtatttttgttacagcagctcaaatgaactaaaacacctcccctctgttggtctggataataagaaattgaacaacacgaatgtcctatcctgaaaataatttaattcttctattccctcatttattgcaaagacatgacagaaaatatttagtaggagcaaggctctgagatttcaatcctaacctctgattccagtcctaaatccatcactaatcaggataagaccttgggcaaattgcttcacctctttgtccctcagtttattcatctataaaaatgataacaaaaataatacttagttcataaggttattataaaaattaaatgagataatgcacccgaatagcttaaaaagtgcttgccacattgtacaaccccagtaaggataaatgttaatattataattagttttattgttattattattgttgttgttccaaattagacgtaaccacatattggtttgcacaggtgccctttctttgtactgtttctaatatctaaccccttctatcctctgcctgagaaaactgtggacatatcacgtaagatctgaagaaagtttgttcactcacccacccacccactgagttcaccataaaaagaattcagaaatttcttacaatgggagatagtaaaaacataatggccacaattcccaaaaagctgcagagagcttatacaccctcagtccacatcacaacagagccactctccactcccttacccagccatgcttggggccactcctactcacttcctcatcattctgtcaattttagaggagcccacggggctcacacaagctgtgcagatcaccaaggttagtatctccattgccttgctccttggaagaatgttcaatattagttcagtgttcccagcccacaacctaaagcctccaggagtcaggatgaaatacaaacaatggcaatgacccctccttatctggaactcacaataatttcgtaaatactgctatgcaccttggttccttcaatcttcttaacatccctccaaagcaggcggttagtgatctcccgattatacagaaaggtagctgaggcctagagattgacatgacttgctaaaattcacacagctatcagtgaatggcaaaatcagaacagcccaggatggctcttcaggcagcaaagtttagtgggaaaagcagccagggagaactcaagttcaagggagaacttgaatcttaacacttattacctatatgacctcaataaagtcacttaacctgtgaggactcagtttcctcacatgtaaaatgaaaatagtattttccattcaggatgctggggcatgcaataatgtgggagagcactgagccaagtgtttggcacagagatgggattaaataggagggtcctattgttattattactatggttaggggagccccattccctctccaacgtacagagccacacggaatctaaactaaggaggccataaaacacactggctccagtctaagtccagtgtctttctccctgccccccatgtacctgccagccacatgcctgaacagcagagagagagctcaatcatcacatgtggcttatctagagaacttttaaatcccacgctggcctgacccaccccagctggcatactctcaggcctctgacactggcagcaggtctgagcatgaggaatacagtatctaatctgagcaataacttgcttatccttatatttaatttatacaaaagtgctttatgatatatggcatgatggcaaccatgggtcagtgaaacatatgaatttccattaaacatatccacttccataaacaaccattcctgttttgagtaggtagagccagtaaggatgaaatgatgctgaagaggaaggcagtggagggtattttataaatatcaatattcaaataccacttaagtcctcatatttacttaataaatatgacaatgggccaggcacagtggctcacacctgtaatcccagaactttggaaggccaaggcaggaagatcacttgagcccaggagttcaagaccagcatgggcctgtctctacaaaacctttaaaaaaaaaaaaaaaatcagctgggtatggtggtgcatgcctgtggttccagctgcttgggatgctgagatgtgaagatcccttgagtccgggaggtcgaggctgcagggagctatgattgcacctctatactccagcctgggcaacagagccagacctcatctctaatatatgtatatatatataaaataggtaacctgtcccctgtcccaaattgccctggggagcactgcaaagccttaaagaaatacattggggattatctgcttgtttggttacccaagctgctacttcctttttgtctataattaatgaaattagaccatgcacatagatgagatccactcaagtctacaaatattgacagcactagatatacattttgaggccatgaaaatgcaatgaggaacaagacacaacccctgttgttacgagggcacagcccattgtgggagacagattacatagcatttacagtacgataggctgagtacgcaggggtaagggaacacagaggaggaacatgtttcctgaatttggggcccaaagctgagacctaaagcgtgcacaggagttggccaggggatgagagggaaaaaaaggagagagagttgctctgagttaaggaaacatttgagcaaaaaatccatttgtaaacagagcttggggacctcagtgctgccactgagtgacaattcataaatgcagcaactctcagccacccacccaacattattctgtgcttgatcaagagctgaagcagcctccagctgctgccaccttctgccagcagtgttagttccatgagggctgttctgcccatggatcattgatgatctgttgtcccctgcatgcacagaccagaaaccccacctccccacctgctgctgttaccctagttgacctcctgcctcactgggtggcagaatggacagccctgccatctgcttccctccccagagcaccaggcatggaacactggggatttatggggtcaccaggcagagctaggagggttttgcagtggtagggaactagcagtacacttgaacacatccatgggatcacagcaaggaggccaaatgagataggatagggattcaaaggagaaaaacagaaccacagaagtacacagctctcagatgaaagccacttaatcagcctcatcccattttccaaaattcagacaaatgcagagaaacactgggcttatttagcagtatctatactctaacacacacatacatgcacctgtgtgttaatctaattagacagcttttctagttctaaaggtgaaatgcacgaagagcaagttcttaggttattttctctttaagcaagggggactcttacatccaacacatgcaacagctatttagtaaaacaaacacatgttttcattctgcttcctgcttggagctccagaatggcctcatctggtcaaggaaggtctcggttctgccagcccattcgagaaggcaaatagcaatggtatagatggcatagagcaggatgtgagtcctataccttggattgccctggacagagggcctattgtctcctctatttttggaccaaatgggtgagaaacagcttatatcaagaatggcctggcacatgcctgtaagtccagtactttgggaggattgaacccaggagtttgagaccagcctgtgcaacatagagagacccatgtctaccaaaaaaaaaaaaaagaaaaaagaaagaaagagagaaagaaagaaagaaagaaaagaaaagaaaagaaaagaaagagaagaaaagaaaagagaagaaaagaaaagaaaaggaaaaagaatggcctggcaaataacccaaagtcctctcaaagctacattactataaacgagtcgcatgcttataattcaaaaataacatttgtgcctaaattcaaactaacacattttaatggaatggcaacatttttaggcctcaactcattctgggctcaaaataataactagaacttcatagcatttgcttgtggaacccatattccttgagcagtatctccctaggcaacagctccagtatatcctgcattagaggatatttcagatgagatgcacttgtgttgcctcagactactacggagtgactccgcagctgctgaagtgttgcctaattgaggatctactttagaaacgatgtgagtgtgatgggtaattggcacgttttcctgcttctgagagtaagctgtgcgctccttgggaggtgaaacccacttccttgtctcaccatggcttgaatgacataataggatttcagtatatgcaattgttgagtgaataaatgaataaagaaacatattagctgaattattgaaacaataagatcaagtaagcccacatagatttgttcaccttcttcacatgccccctgcctgccccaaccacacctcctttcctttgccttgtttgattttccaccaggctgcttattatactatcggacatgtaagcactttacttggaaatgtgtttattttcacatgctgtgtaaagtccaaagggcatggatttttatctcattcgctcaccgctctactcccaccacctagaactggtccctagcaagagttcactgagcattttgtgggggagttcattgtaagactctttaagaatcactctatctctaaacagaaatgatggaagatgtttttgttctgtgtatcaagggtctttatatatgtaaattaatcaaaaattaaggtgtatttgagggcgcttggtcttaaaaatgtaaccattccaccttgcactgttttcttacaaaaatctttgtaatttggccccaacataccatttgagctttattacatcatcttcttcattaccacaatcatcactaccatcactgttatcattcacaattacagaaaacatttaccaactgcctgctgagtacaaggcattttgaaaataggtgtttgggggccagaaaatgaatgggatgctgaggtctctgttctcaaactgcccatctaatgcaagcgttgagacatatttacacatgaaacatacactcagtgtcaaacaacgggttgaaccagttctgtctgacagaaatataataatgagagctatatagctaatttaaatttgtctattactcatattaaaaaatgaaaaataaacaagtaaagttaattttgatactattttgcataacccaatatatgtaatatattataatttcaacatgtatccaatatttttaaagttttattaatgagattatttttcttacttagttttggaacatgtatgacacagcacatctcaattcaggctagccatattcaagtgtctaacagccatatgtggctactggccacatattggaccctcagggttagactaaaggattttcagagtacagaggaggggacacatctcagcaggcacaggagtgtggagaaggtcccatgagaaaagcctctccccttccctccttttcctgctctttccttccccatcttcctcctcctcccgtcctcatccttatggaagcacaagcggtatagttgcaggggtaaataggtgtcccaagatgaaaacaaagggaaaccttgggcttacccactgagagtccctgttccacactgcctcttcttctctttctcctaggcacagccaaggaaggttaaatcccattccatcactaatgagagatctgcccacaagcactaaaataagattcctctgatcttaaaagaaaagtgtttttggactttaggcaaccctggggacttagagttgttctcaaccctagcatccatcagactcacctagagaaaattttaaaagtaaagatgccacaagtatacactcccagattctgatttaattggtctagagtgaggcctagggatgtttgcaccttttttaaaggctcctaggtgattctaatgtgtaactagacctgagaactgctgggctggggtgcagaaattgcagagtggaggagaggaaagagtggccagttggctatgatgccattaaccacagcactcagcatcactttatgtaccctttctcgttggatccatatgataaccctgtgtgacaggtaccactaacctcattttgcaagtgagaaaaccaaggctctaggaggttaagcaacttttccagggtcacacagttagcaactgggaaaggaagaaactcaagcccggtcaggtctgactccaagacccatgctcctcacttcatatcaccccttgtccctcctcttcatcaaccttgccctccatttccactccaccaatcttggttcaaggtgagaaactgggatgggaatgagaggatgaagaaaactaggtaagatgcagggacaggttgggaaaaaatagtaatgcatacagcagatgcagggggaagttgggaaaaaaatagtaatggacacagcagcaagggagaaacctccttcatagatggccagcatctcccagatatttttttaagtgctagatagattaagtgttgaaaggacacatgcaggggagggtgctgatattgactacgagacttgtttggcatcatgacaaggaagaagtgatgagaaaaggtgtcccagaaaattaaccattacctagcttccacagaggatcctgccctaaccaacagataggctagaaagaaggctacagaacagaagacaaagaataaaagagctgtacacaaagatatgttctttttctgaggtttcatacactgtgaaatttccaagtagtgaaaaattaactcaatgcttaaaaaaaaaaaagaagatgaatgcaaagaaagaaaaaaaaaagaaaaatctggcaatgttggaagagaaatcagtcttgcctgacagtatttaaattgaatgtctgtgagcatggcccacaatttttagtgaaagtagaagctattaaaaagtcgatgcacaagattaaaatttagaatgctattttaataataccaaattctactcaatttcaaatggctgtcatttttaagctccaccaatttgataacacttgactgatggcattgggagctgagtgatgggaagattgaattcggcaggtccagctcagctgacacagccagagagatgaatactcatcctcaaagaactaagcagaccaggctgatggacctcttagaatctgttttcccatctgtaaaatgggactaacaatatctgccctactgaaaggaacaagtgtgatggagggtgaatgaaccattgtcaaaagcattgtgaaggtcaagaatgcattgtgctcccgctgtgggtagagcctgtgctaggtcacaggtcacctctttctggaagcttcccacatctcccaattctaacttagagaatcaacaagtagttggactagtcagtgctgggatgagaacatgctcaggatgttccagaactcggagacaagtcatctgtcacgtcattagatccaccaccttgtaggactgggagtttgctctgtgtacctagcactgtgcctggtatacagtgagtggatcctcaataagtatttgtagttccctcattcaacaggatcttgtccctaatgttttgactttagatgggaagacaaatatttaccaagcataatataagtactgatgcagagaccatcagagcattacagaggaagaagaaacactaggccgggcatggtggctcatgcctgtaatcccagcactttgagaggcccaatgccaaggctaaggcaggcgggtcatttgaggtcgagttccagacctgcatgggcaacatagtgaaaccccttctctactaaaaaatacaaaaattagctgggtgtggtgctgcacacctgaaatcccagctactcgggaggttgaggcaggagactcgcttgagcccgagaggcggaggttgtagtgagccaagattgcaccactgcactccagcctgggtgacagagtgagactctgtgtcaaaaaaagaaaagaaacagaaaaatcatttcaactggatattgaaaaatcatttattataatcactgtggtcatgtttaatgctgttgacaaatatttcctgctcttcacatcctaggcatgcagcaggattacattaccctgcaccctctgaagttaggctaagccatgggtcctacactggccaatgaaacatcagcagaagtggcatatgtcccattttggcagaaactttaggagctgtgcagttctccatgttttcttcctgcagtatggcaaatggaaggacatgttaaaatgaagaatcttgggggaaaatggctccagaagcaggggtttcagtacaacctatacagaacatgaaggacaagcaagaaatacacctttgttgcagaatccgactgagatttgggggccatttgttattggcgcctctctttactaatacaatcatgtcaggaggagctccagcaaagtatctgtaagggaaggggtgagtgagcctgaaggctcttgagagtgaaaaggaaacaggactcaagcctctctttggtcacagactcagctaccttctttcggagatttcctccacagggatacactgaaaatgccactcaggtttcagaagcctctgagtgaggagccccagactcctgccttttatatacccatctcccgccctcatgccttctggaaatggtgctaagtatagctgggttggatccctggctcaattactacatcacaaccagagactgaggaataaacatgccagggtggggctttttctctttgcccgggatggctctgcctccatctctctcagctctcagcgaaaatcctcccctgcagccagaggcccttacagaccctaagcctctgctcctgctcttctccagcaggtgctgcctccccttctcatctctgcatctgtctgtcctgcagagctcagttcacaccccatctcctccagggaggaccactacagactccagcctattctgtgctcatcctacgagctttgaacccatctgacactcaaccatgccctgtcatcagaatagtgctagcttgttcatctgggcaggttggatctcttcaaaggagggaggaacccctaaatcttgatgatgtcatttgtgaaatgaggcccctgctctgaccactcagaactgccattgggcatcaggtgagttgtcagatctaaagcccctgtcttggtgccaaatacctaacaggtgctcaagaaatgtaagactcttctcaattccctttgtctacaagacagtttgacaaagtgggaccagctcttctcctcccacagtaagcccagatgcgtctctagagatgtgtctcatgcatgtattctcaatgggggcaaagtctcctccaggaaggcagacattgaaaagtgaaaaaacaacctttatgtataaacacagatacatacagagtacacacacagatatacagtgtatctgtggtattaaaatctcatggggagggggtaaggaagtgtttttttaatgcttagaaaagctccataggtatgcaataaaggaaaaaaaaaaggcaggctcttccatgcccatctcagctgagcctcttatcacttgtctcttatatttcctctcttgtgtctcttccaaatcaataaagtgatattttagaaaattctgccaaacccacatttctccctcctccaccgccttcccagcctctctgctcctgtgctcatctaatctgctgcctttcctgggatgtcagccttgcaattggctacagggaaagcaggcactggagagctgagagactccagtcttggttttccagacatagcagatgtgactgtgtttgtatctacccccagcaacaccatggggaagcagagctaggcactcctgcctcaccccacctccccaccacccagcttgactcagaatggtgcctcaagtcaaagacctgcctgcaactcccaagagaactaaatgtttccctccactaggggagggttactggtgggtttgggcttaggctggtttgttggaaggtggctgacactgcagtttggctcacccaaggtggagtccaaccttgcctgtcctcgaagatggaaagctgaataatcaccttccagcctcccttgcagctataggtggccacgccacatattctgcaggggaagatgtctgataaaaagcaggagggaacagcttaacctgatattgcccttcccccttttctttctaccttgaaatggacccaaagtctgaagctctccatctctcttgcagccatgagtgaaaagccaagggaatcctgacatcctacagacactatcttgacatgatgtagcagcagcactagtgccagaaacccctacatctagacttctacttgtaggaaaaactgcttttctctctgttacatgaagcccaaggaatcctaactaacacagaagtcaagagtgacaggcacagacacatgaaaaaatgctcatcatcactggccatcagagaaatgcaaatcaaaaccacaatgagataccatctcacaccagttagaatggtgatcattcaaaagtcaggaaacaacaggtgctggagaggatgtggagaaataggaacacttttacactgttggtgggactgtaaactagttcaaccattgtggaagacagtgtggcaattcttcaagcatctagaactagaaataccatttgacccagccatcccattactgtatatatacccaaaggattataaattatgctgctattaagacacatgcacatgtatgtttattgtggcactaatcacaatagcacggacttggaaccaacccaaacgtccatcaatgatagactggattaagaaaatgtgcacatatacaccatggaacactatgcagccataaaaaaaggatgagttcatgtcctttgtagggacatggatgaagctggaaaccgtcattctcagcaaactatcgcaaggacaaaaaccaaacactgcatgttctcactcataggtgggaattgaacaatgagaacacttggacacaggaaagggaacatcacacactggggcctgtcgtggggtcggggggagggggcagggatagcattaggagatatacctaatgtaaatgatgagttaatgggtgcagcacaccaacacggcacatgtatacatatgtaacaaacctgcatgttgtgcacatgtaccctagaacttaaagtataatttaaaaaatgccaaaaaaaaaaaaaagagtgacaggcataatccttacccatctgacttccctggagtctctttataaacacatctgtactacaaaacagaatgactagtgcttctcaatgtccagagtgcagggagactcagagatgctctgccatgctttaggtcccagggtcatggcctctctgcagggggttaagcacatgggctttgcactcaaattgacctggattctagtcctaactcctccacaaaagctgtgtgatcttagacacctcaccgttctgtatgtccgttgttttcactgtagaatgaagttgacaacagcacttatctcatagaattgttgcaaagattaaatgagatatatcacacactaatctcagtgcctggcacatactgtcttctcaatacgtgttagctgtcaagataattttccactttccctttctgggtctaagtccttctatgagcttgtctgtctcatttcccaattatttctcagtgttttctcatttccttatctctgtagctctttccttctcctttctctgtttctccatctctctgcatgtgtctccatttttgtctggctttttctccctcctccctcattcccattcaggtttacagtggagaaacacagcaatttgcctaattttccctctcccaggtcaagagaaagcccttcccaggctctcagtcacagttccttagacgtgggtcccccagatccccttgtgttctgaaatgcctgtgatgggaaggggaggggatggtgatgtggtctcctgccaggaaaagttgctgaaggttggggctggtgaagggggtagtgagagaggggcctgctgccctgcctcaggaatcacgtccacttcatgactggctttagcagctgagtctaaaagctttggaaggaaacgctgggtccaccactggctccattcctgcctccctttctggcctaccccaggattccttggcagaacttggaatttggtatagtcagggacaaactcttctctcagatgcttactgtcccaaatggaaagcaagacctaagtgcataatcctaacccaccatggacagacccctctggctccacagcacccaaaagacccctctggtgaggggagcaagtcaccaataataacccacaacacttgccctgcactgatgctgcttcaaaggcctttcctgtgccaacctactgacatccttgcagctgcaccaaggaacagactcctctttccccattttacaaatgtcatggcacatgggggctaagtgatatgttcaaggtcacacagttataaatagcaaagacatgttccaatctaagcaataacaacagcaataataacagcaacagcaaaataatattaagataattttaatgataaaaacacaatgtagcatttattatatgccaggcacatgcaagggctttgcatctattagctcattaaatctgacgcctaccctgtgagataactactatcattgtccccattttacaggtggaagggaaggtcaagggaaattcagtcatttgcccaaggcctcgataccataagagtgtggattcagggatgtgcatgctgcagtggccaaggcccacaatcttatgggacagctgaccacccaacccccagccagattcctacaagccccaggagtaaacactcccatgaagaatcagctcaagctcacctccaggctgagacaaagggtcaccaaggactggccaccacacgaatgcttctccttggtcttacaaaacatgaaaggtgctattatcagaagccatgcctgcttgcaaactacagaggtgacacgaggtaaattcatttccttcctgtcaagagaaactcaacaagggtataatcagaagctaatgtgtgtactgtgattgggcccatcacggggtggcacataattgaacaagttctccatgcctggaggagcagagccgagccccatcactgggaagtgtcactcatctggccagcacacattggtttttaataacattatggaaataatgctgcagggctgtggaaaggacagaagcttgaggggcagggcctcatcaggtctccgagagctttgaccttgagaaagaaccttctggccccatccagaatagccactttcctcagggatctctcctgtaggctttgtggatttatgtctcctgggcttaaggaacagggcttggtgtggctgaaccttcttgctgaatggatcccaggggaccccaggtgagcattgaggccgggttctcaagagactgaagggggtcggggggttaccagagagaggacaggccctttgcttccccagtaactgttgacaatggtaatacctccatggcccctactatgaatcagataattttctgaggactttatgtatattaactcatttaaactgaaaaacaatccatgtgataggtattgccattgtcctgattgtatagataaagaaattgaggcacagagaggtgaatttatctaagatcacacaggtgggaagttgtgtttgagcccgggcagtccatcatcctaaccatactccctactgcctcaatgagctgacacagcccagccctgataaagggggtggcagaggggagggggatgaggtgccttcctggctgttggcattcatttcattcacatttttatcaggcacccctttcaaccagatactgctgtaggcactgaggatacagtggagtataaatagataagagttatattctagcgaggagacacaaatcccatataaatgtacaaataagacaatttcagagaatgccaaatacaatcaagaaaataaaaccaagaggtcatagtgtccgtggcaggaaaaggtaagtaagttattttagagaggaggaaaaggtaactttaagaaccagagacaactgtttaggagaaggcctagccaagactgaataattcatgtgttaagaggttttcaatcacctaccaaatacaggaaggaaccagtcattgaggctattgagaagtcaagaagttagagacctatgaagacaaaggcagcctgggctctgctccacctgcccactcatgggcctaggcatcagaagctccgccatcttgcactgcaaccctggaagccacagtctcttcagtgccatcagggaagacagcaactgcaccaccacacacaggcatcccctgccccagcccagaagtgatgcacatcccttagtgcctcatgtcctgcctaacagtggatgctggaaatttacaggagcaactggaatattcataagcctaactgcctcggccaccagcccacaagggacactaatggagacagcagagttgcgtgagggctcacgagctaagaggtggaacccagccaggctgagtagaaagtaagccatcgacaagcagggagttaataggtttttccaaatgaacggtccttaatttcaattcattgagaggtgagggatcaggtgaaggaagcaaggtgaaaaggaggattaatccatccatcaaggaccttgggtactgaaaacatgaaaagatgaatgcatttgtgagacatactgattcactaccatgagaaataattatcttgaagcttatttggtcccagaatcaatctttatttaaccgtacttatttttggtggctcatcctgcttgcctctcttggaaactcaagaaatgctttctctatttttttttttgggtaaattccaaagacttgcatatttcatatttttcaacaggatgatctttgtgtagactgactgtcttccctcttcactagtcctctctatcattggacctcacccgtagtaatcactcactccacaatcatcttctcttgtttcctgcatcactcatcactaccttaaagtattatttattgatttattatttttttataatctgactcttctattgtaatataaggtgggtaaagacggagacctttcctgtctccgttggccacatccccaacaccacaccaatcaagcaacagactaaggacacagctaaataaatgaacaaaaagataataataacaatcatgtgttagtcttcataacaatcttcatttattctttttgattattcccatgttacaaatgaagaaatggaggcacagagaataattaagtaacttgctcaaggttatacagatattgtaaaacagccaggatttgaaaccagagagtttggctagaggttccatgctttgttggtataaatatttaagaaatatttgttgattgaatgaataataaataaatgaatggcttccttgtgtttcctgccttctttaccagggttatttgccttcaactttcactggaccctctatgtatcaggcatggtcttaaattctcttcacacattattcagttgagggtagtcccatctaccatatctccatagaatcggtcccaagcctggtacttagaactgccctgcattgtcaggctccccctttgccaggtggtgcctccctaatctgaaatcatggactgagtaccttcaaaagaaaaattaaaccaaagatcaggaggagatgcttctgacttagtgagtctagaagaccctggcctcccttgcccactctgcccagaaactgaatcccagagagatgaagttatgggtttcatacctgtgtctgcccatcaacccaagggggacaaatgccaacatagaatgacagagagggaaggaagaaagtgtttttcctaattaattggctctaaaagtggagaggaaccaagttgggttattatagaagcatcagcgtccgacacaggtcttcaactgccatgcaaataccccctactctgcaccatgcagttcccatggtttactctgttgtgatgtaactgtgcatgtttctacctgaacccattgaacacggctttgtgcttgaaccttgaacaatgcctgggacacagttggtgctcaataaataatgatgggataaatgaatgagggatccccattctcctacctaccttggccttgtcatcatctctcacttttgcgactgccagataacacctagctctatccccttgagccatccaagtctcagacacattcatatactgactgaccttgaatacatactcccttcctgaaagagatgcttcccaggaccctgcatcatggaaaataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcg

SEQ ID NO: 2527 - DNA, 752944 bp, Homo sapiens; identical to SEQ ID NO: 2526

SEQ ID NO: 2528 - DNA, 752944 bp, Homo sapiens; identical to SEQ ID NO: 2526

SEQ ID NO: 2529 - DNA, 768220 bp, Homo sapiens
tgttttagaacacaaatacataaatttttaatctgcgaaaaatacaaaatgaaaccatgtacaagttatgtacaaaccctttttacaagacaagagagttatcactggttgttacagatgacagagttgggtagatcatttcagagcaccagcatatagtctcttcttcaattcctgtcaggtcagagtaattaatcataatcataatcataatgccaacaatcaaaagattgaaagatgaataagccacgctctttttcctcaatgaacatgtaggctgaactctgcatgtgtgtactttttttttctttgtcccctaaagaaaccttgaagtgcaggttttggtgttaagcagagaaaggtttcttttcaacatctgggtggtgggatgtgggccagaagttttaggcaggatgtgattgtgccacctgggaatgcaacgtttttaattaggatttcccaacagatctgggtttgtgtttgaaatgttgcagttctggtcaaaggcgtgtcaggctgcattgagcggaaggaaggggaggagagcgagcgctctggggcagatgggactctggttttgtgtggaagtgaggctcagtccaccttgcgggcggggctcctgtccctgccagctgccttcccacgctgaccctgagtcccatgggagggaagcactgggtcactcccgcaggcgtgtgtcaatgccttgtgtacatttccatctaagattctaaacagtggggcccggtagtgcttcccaaggcaggcatggccgagagcattggtgtcacttctgcccctgttctgttaactagcaagatggaggagaagcagcagcacagaagtcctcaagggataagcaaaggaaacctttctaaactgaaaaacctacctaaaaataaagtccactttcacctggccagaacatctcttctcacaatgcctgttcagaaaagccaccaaagcaaggtggtcgtagcatttgttttcagacccctgaaactaaggatgcagtgtgtgtgctgttcagggagggaagaagaacagtgcagtgacatgcacaggaaggtgaaaggagatgcccaccctgagacccctccctggtgagtcctccagaaagactgccgatcaccacaggttctgtccagcctccatccaccatggcagccacagtgatacatagtggccgagtgactgcccacgtgggccagacctcatgacaaactctgggaatatggacaaataagcagagttcctgcccttcgagtgagtcttttgacttgtgcctcaccatctccaacacctttcatctccaacctcatagatgatcttccctctctttcttaaaattcccctcttgtttctcatttccctggttctggagtaccctagatctcctgtcccaagaagttctacttattttgctccttcttagtcctgaaaaacttggctgtagcccacaaacacatctgccagctgatctaaacctacactttctccctaaaataattcatccaggatcctcactttctaagtgcctctgtgggtctggcttccacatctgcagggcctgttgtagcccactcctttactcccctgtcccactcctcttgcctgtgtggccttccctcacggacagctctcagcttttcttgctctggatgaacccaatgtaacatttcttagctgctgtactcactgcctccgcttcttgcctgcttctcttgttttcctattcctccacatggttctgtccttgaggacagattaggtgtgtgtccactgcacaatgaatatactctagacccacagccattgccccacatccagtccctacaatcccaaccaatcttctacaactattacgatctataacatttatttgctattcagtgttcacatttattcaaaaattatttattgaacacctgttttgtgcaacatgatctttccaatatatgtgtgccttgtgttcccagttaggcaggtgggctgtcttcctctaatagtcttaccatcgtgaggacacagcagctgctcagtaaatatcaattagcagttactgattaacatcattcaccctgccacatgccagataatcctgccttcatacctagaatgctgatcctctacttatctaactcctaaacccccctttctctagaaatcctaccttgttgaaccacttcaaaccacagcatttctcccttgtttcaactcctaccatattgaatgtgaaactatgtcattagggctcaccctttctctaatggtgctttgagcatgttttctttctttagttgtattataagctgattgatggcagaacccatattgtgctcatttctcccccactcactccttgtacaaatattttatgagtgctaattggtttctaaacaagggctacctgattagctgcaagggtgttttcataaggggaattcctatttggcagttctggactattaattattctctactatttgtggatgtcctgcctcatgttcttattatattactgtctagaaaacagtatgattggcaggtttttaaaaatttatgtatctattcctaccctctaatctactttgtgagtttgttgctgacattctagtaattcaggagagtcaggacgttctacgtctgatggtcctgtgacagaaagcaaagcaaaatgtgtgaggaaggtgctgcacacggtgagttgttgacttggagtgtgcaccctttagcactccttgctgctgagaaaatgttcagttttgtgtgcattctcatgatatcttccaggaagaactgacatctcactactttcaacctgaaaaatgcacagccattgctgccccatcactctttgcttaaaactctgagtggcttttcatgactttctaaatcaagtttcaaactttatctaggcctttagactgtactttgtagccccttccatgaagtctcatctcagttttcctcagttcccctacacaaacttatcacagtagacaaaatagtcaatctattgaaatcacattcctacaaatacatcatggcccattaagtcccatctccctggaaaaccctcatattccacatctttccagtcctgtcacccatttactattgaaatgcctccaaagcccatcaaacattgtatacctctgcattcttgccagcctacgcagttcaatgcaaactcttctttctttcaacccaaagaactactctttgtaccatatgcatgcccataactcatggtattttaaaatactgcttattatatctttttcttttttttctttcttcccagattcttaatgtataccccaagtttggcttatctttagatagggagtctcaggtcctttttgtgattaaaaaaatatgccaaaagaggaaggtctgctacaggtggtctaagtcagaattctttctccaatctatccatgtggggctgtgatatcatggagcttccaactgttgtagggctaaaggtgcctctgcctttgagcatgtaggcttctttttatacatgttttaagcaagcttaccataaaaattgaaaattaggctctgtggtctcttaagaaataaaattaaaaatgttttccaagttttcttatttttatggaaatcttgaaattattaacaactgatactttattggaaacaaacaatcagaagagactccacttaaacaaccaatatgaccaaactagtacaaactgcctaggaatcatttataattactactgtctcataaataaatccaaatagcgtcatcacctcctcaaatgacctgggatttatatgctaaatcatctctgctggattaaaaaaattgccttttgggaataaggagaggatcagaaaggtaatttaccagaagattgtaagtaaattctgtttcttttgctttttaaagagggtgagtcaagtcctcattagtgaaggtcctttcaaggctcatggtgactggtggctttaccaccattccaaaagcagcaagtaagaacaaaacagaaaatggacagattctgccctggaactcagtgttcaagctgaatggatctacttagtctcctaggagtcaagccggctcacatctcagtcaattggttggatagtctttgtttctctcccttcctacctttattcctcaatttcttccttccttccttcaatgagattctctttcacaatgaaacacaatagattaaaattacatttgtgaatgtaagtagctaagagatggttagtttattaatgaaagaaaataaccaaataaacagaggacaggaaatgaagtgagaaggaagactggttacttcctgaagattcacatggggaaacataaatggggaaaatggcaggaatttggggtctcttgaacctctagttacatactaggaattggagacatggcatagagatgaagggattaactgaagctgggccttgaaccaaaaaaaaaacaacaaaaaagggaaggcagggatgaaactgagaagaaaaccctagaaacaggcagcaaaatttgaccaacgtgatgcaggtgtgtccaaattgagaaatctgcatcttgaacctaaagagaatctaaagtgaaaagaccaggaatgaacctacctattctatgtccagagcagaaaatgttcaccactcctgagtaaggctgggagtgttgcctgggtgatgcagcaaaaaggacctttattccagtcctggacacaatagtctgcatgggcttagccaaggagaagcagccactcccatgttcccactcctaacttagatcacgtcccctgggacctgaaagagaccttagagtcatctagatgaatcactctcatttacaaatgaagtcactgagactcagagagttttaaaaacatttttaaagatcaagtttgttgtttgtaaatgtggctcttgcaccctcatattaaatggtaactagggaacttgtgctttttctcctttcaacatgaaaaagtcccaaatttcttatgctttttcacttttcctttatctaaccctaacacttctaatttcctgtttatttaaaatcttcaatcaatttttttacaaagtacatcataaggtgccagaacccttgggaggaaagattggaatgttctccaacgtgccttagtcacaatcacttttatttaaggtgttttataatggttcaagatgatattctaaaatataaaattgcttagacaaaaataaaagttttctcaaggagaaaggttatgatggtgatgatattttctgctttgtaaacagcctgttggtgacccacagcacccaagaatcattagtttgggagaatggcttttctggagccctaaactgggataggaaatcagagcctcataatgtggactgtaccaaagaccctccttggtctcaggcggatgtaggcagaaagacagactgttgcagtggagatggatgggactcagggccaaagagctcaacaagtaggaacaagccagggagaagctctggcatttgcttgagccctccagtgatttcacaaatgttatttctgtttccatttcgtttctacttaccaggcaccagcttttgccaaagggcccaacaatcagtcattttcctacccccttaacaaaatgcctcattttgttttctagtccagaacaattcattattacaacggcaacacagtatgaacttattgctctatttaaaagaaaatgaatttttaccaatttggtttttttgggggggaggtgcttatgaatcaaggagccctttgctataggaaactatcctaactattatgattttttttaaaaaaagtttagattaaaatttctagccacaaatgcatcggtggatgtgtggtggggctggagtttgcatttctgcttccagattgccttgttaggggagacacagggaagagagggtcatgggaatggagctttgtgtcctgtgtccctctaatggaagatcctttatgtggccaccacagcctgccagaggagaccaaatcactctaacaaatttggaggtggttattacgagcaggagtgaagagcccactatggttcacgaaggaaagaagagcgtggattgacgtgaatatactaaggtgaccccaatgcaaaatcattatgtaaaaaaggcctagctttcaggaaagttgtcaaaatcctagcaaaacgttctccccacaaacacatttgacttctgttggaaaccaagaaatgtttataagcctgaatatagactgttgacatcattttagtctgctgagtaggctagtgattaattataagtagtttttaaacaatccaattggacatacattgtattcacaatacttttatagaactaattctacaaaatgtgacgacagagtaaccacagtccgacaaatcactgcaggacaatgcctacgaggtggaagcacgactatattggctctgcagggagtggacagaggtggaagctcattttgcctacgctggtaattggagtacttagtggacatatgtcttcatgatgatctcattgctttgctctgatctgatttgcactaccataactaggtaccacaggtcatggcccaaagagttaatggactagatatcatgaaacttcggggagatactttggttagcttggttccattaagtgtccacagtttacattttttaagaaaatagaaatcactattacatccatgcttctccagagaccttgatgatcatatcaaagattgataattttaaagttgaaagacttgctaagttgattggaacaaaacagttgccgggagactgtacaccgagcatgcaagcgatagcagagctctgagacatcgtaattgcatctgatggctagaaaaatcttttgaccgcagtttaaagtggctaatttatttgatttcactgctggtaattttcaaaggccttttctaacagtctatatgaagtgcattcgttgctttccttttgttattattatttttaaattgttgtaacaagttcatgtgtttggccccagcaactaaataaaggagagcatgcaaattaaaatctgtctccatgattgtagaaatttcctggtttttaaacaaaaactcagtgagaagaatgactgccctctcacatcctatggtaaagtaaaactactaatcagttttacaaacttccaggctaaaagctctgagacttggggagtggggagaaagtccaccagaccctcccgaagttgacattactcgctcaggtggtttggaaatataaaatgagaagcataacagcacgtaggagtctccaccactagaacagcaaacagagcaatgccttgtgtgcatctggtcctcagcttccacatcccaggtgtgcccacaaccctcctggtgtccttagttggccagacaaacctgatctgccaattgtagaaaagcagcagaaggtcttccctttaaaaatatgaacaaaggggtgagaactacagaatgaaaactagaactacaaaaatatgactttcaactgtgaaaataaataagtttccatttattaagagctggtgtcaatgcagatcaaaatacacacccatccaggcgaggagcaggtattcacctgtccccttagtcttcttttctggatttactaaaatacatgtatacatcattggccattttaaaattgttttaataattcatttcccttaattacaattaattgtggtggtgaccatcattctcctcaaagaaaaagagagaaagaagagaaaaacacattaaggagtctgaccacttattcatttagattttgcattgtttagatatagggaagatatttgacaatgaaaagaaaaaatatattttctttctaataaataaaaataatttaaaatgctagaggctatacatgactattttagtatgttcatttataaatgaaatcattttcttttccaaaatacatggaagcaatattcaaggcagacaaagagaaagatctgtctactttattttctggcaattcttgcttatcctaacgtttccaccagtgattcagcatgtaagaagaaaagtcacatcaccatttatgaagtttgtcaggctttaaaaaaatagttctggtctcctgggagtcaacattcatcttcaacttctctgattggtggaatcaagctgcttgtggatttatattggttgatctggttagccatgtgggtactcatgggcttgatttgaatgtttctgggataggcattatccggttcatctgtaaaccatttcttttctgctaaagggcaaaatggatagagaacaagaaggagaaatgagaagtttaattagtcctagggtaaagcctttggaaagttcattgaaaaacgcaaaaaggtaatcgatagaagccgacagtgagtaattgctaagagagacagtgcagtgtagggaggaccccagaacctgaaatatacctctgcttcctgtagcaagtgatgaacaaaatgtgccactgggactcataggcaccatgggcggacctcagaggctaaggagggattggagaatggactctggcaatgtcccttggagttaatttcatggccagaaaaggtttggtggggaggggatgttgcatatatcagccattgggtacagacattgtgcctgaggagagatgtgtgcatccattgatttgagtggaacggaagggcaccatcacccttgctgcagagcgagtgatccagaatcttacacagaatcaccacctcccagccttttcttggctttgcttataatacacacacttaaagccatgtctcaactataccactctcctgtttcatttgtagccactttggggggtctaaactaaacccatagattttgctggccaaaaatctatgaaaatcagaatagcgaccaatgttttaaagaggattttgaggtggcttttatttcaagaaagaaaactctgtgttggtataaagttatgaatagagttccaagtggcaatatcttaactgactataataacccaagctgtcgacaagggagctcaatgaagtcttggcatttcatttccaccctaaatacagaaatggctgagagagaatgctgagtcagggcgtttgggggctggggtgagaatgaaaatggtctagcatcctcttagcagtgcaaagctattttacaagactcaaccctcatccccacctctttctaggattgaaattttctgggaaattggccatgtgtatagataggaaaggactgggcaaataggacattctaacttgggaatcatatgcctcactttagtggcttagggaaagaaaagaaaaagaaaaagggtaaaagctatcaagcacgtccactgctatagagacaatggcctctgtagctgctttttctgcttaccagaacaatttgtaactgccttgtcagtggtcctgaatggacacattagtgaaaactgctcacctggtttgatagggggcgttgggggtggggtatgtgcatgtttggctaatgatttataaattatctatgatcagttcatgaccactctgcttgtttctcctcagttcctacttctgctgtttcaagtgccctgagctgtcaatgtcgaggagggctgtcactggagctgggatatgcctgagtcaaagcctcgccccagtttaatgcggcagctcagtttaccccacaggaaacttgctgcctcttgcctcgttctccccaccccctctcctgctctggctcactcacctattataattaagttcactttgatttgaacagattggacgataggaattcataatgctacatcctcacagtgaagctaactgattaagtgctttaaattattccccctgacagaatgataaagttacaatctgttctgagatgatctacagcttgccagactcctacagcttctttctacattcatttatctttttgtcaagcagagttttttttttttccctaagcttcaattccatagatcttttaaagtcatcagcacatctgaattattaatgaggctttagaggcaaggttcctgatgggctggttaaaaaaggttgtatagaaatccgggactgtgtacacatcaaaataatttcagctccatttaaaaaaccatttagttcaagtgtgacatagatgaaccattatgcatttgtggaaaccaattttttgtgatctacgattaaactaacctttcagagaggagtaaagtgtgatggttatcatgttttaaaagctttgccaggccgctgaaacaatttcacactacgactttttccaggggtttatgtgtaaagatgattttcagagaggttgagcctggtgtttgtgctcaggttgcctgagctgccctcggttttggccatgctgttatgcagactgactttgcaaagggatttagtgctaggttggacatgccaggttggaagagtgaactcagctgatggaaatgagtaggtcttttgggtgaaagacctaagacagctgcaatttgctgaaatttttacaactgctgaagagaataattgttcggaatttagtctttacagttcaattcaaagttggcattttgacctttcgcggcagagagaatatcaatttccttctgctgtctgtaagaaagagagcattatttcctcatttaaacttctctctttccttttacatttcttgccattaaaaaaaaaaatctaagcagagtagcccatgttttggccatgctgcctcaacacaaggagtgagttgtgttaacacacattgtggtgaggagttgaggtcttccttatgcctgagaaacagctgtttaatttgggtgcctcctaagatataaatgtgtgtgtttttggagacttggttatgtaggatgttcaggaaacggaactgtatgaatgctctgggcgttttactaaaatgtctggtgcaaaggtattttacgaacagattctcccaacatgcttccaaggaacacacatttcaatgatcgccagccattcagcatccatggagagtgctgcaagtaggacaatgataatttgatgtattgaatcttgccttctgaagaagaaacaatgccaatgggtggctacaaaattgaccacgaggaagaggactcagggaagcagctctaatgaatgctgccatgacaaggataaatccaaatccctgactttatctccactccctgtttcatctcacataccagaaagatttccaggggctttattttcatctctaagatgagaagggcaattgatcggggtgggagggcttcctcgctgccagagaaaaatagccttatttcttaataagcttcttaaggatgagatgcctgttgtcagtgctctgagtacaatgtgtgacatgtcaggagttcgtggagttaggaaagaagagtcatttcagtctgtggctgggagggggctagtgggacaagataaaactctggaaaacaactgcagagagatgctggtagagcaattgccactgccattggcagatgtcacctatcaagaccagctatgctatgagctgtccaccatgaagaagcaaggagatgcgggctaaggagacagcgcagggcaggaggtgaaagttaagcagatctagctcacgtactagttgcatggctctgaacaagttattagcaaatttatcttagcttcattccttttctgtaaaatagggctgatgatacaaacttcctaatagtgttgtttagataaatgaagccagtacccttgaagcacttacacaggtccagatacatggtaagtaaatgtgagttgttaaggttatgagtatttggaataatatcagcgggcattatatcacagtggctaacttcacagactctagtgtctctcagattctgtgtctttcaaatggagacacagcatctccatctgaagctgttgtgaggattgagtttgtataggtaactaaagagtgctcatgagaatgcctggcccaaggcaattgctgaagcgttagcttttagagtaagtttagtactagcctgagtactatcagtactaaaggatgatgtaagcatgggtcgtacctcttgaatgtgatgacaaatgatgcccttcagcagagattctgggggtagagaacaggggtgtgtatatcggggtgtatcctgaagaacatggattgtggcagcagaggtgacagagggggatttggttggtcatcttcatttggaaggtaaaggagaggaagaggtaacctggtgttatttctggggagcttagggtttttcccctcccagggtgactctgtgcctctgaaatactggctttgactcaccaggcatcctatcccatctgagagccatctgtttcttgcatttctagtttcatcactgagatcacagggtttaaaataagggtcaaaacctcctccagccacagggctgcaggtcaccctggaggaatgggctcttgcagggaagggccccagagctgggctgactgagctgccaccagcagaggaagaaacaggctgcactgtgataattgagcttctctgttggctctgtgggttgtcagtgccatgggatttagccttttcacagtactcccttgagaagatcgcagaaaaggggagacaatgatacagcaaaagcatttggaataattggccctcttctcactacaccacaagctgaggttgagagagaaaaggctcaaaaagaaaagatgctgtttggagagagacaaccgtggagaacagtaagggctaacaaggagcttcgaccttcaagggtaatgctgtgtggtttcctgtcccgcgcttgtgataggcagcctggcacacttcctctgcccagcaaaccctgatgcctcctccgtccccacccacacatactacctcctctcctctctgtgagcaaagtatgcttatttcatagagatacaaattatttgtaccagaacaaaagcaattaccgtttatgaaaaaccttctcacttctttgcaattggctaccatgactctgtctcttttaactgaaagtctgatgctgccattctttgagcaaactgctctcccagccctcctctgtggcccttggtccagccaacaccctgaggacagattcttcactaatccctttcggataatccctctcacctccaatggttgcaatgggcatgcaatcttgcatgggagacagtcagccagtgtagtgacaggtgcccacagctacttctttatcatattgtgacaaagcagggatgggctgaaagaagctgattgagaaattgatttttaccctgtcttgacttccacaggccctggagtttctgtactctcctctttctccttcaaggagcctgttgctataggaacctggcaggttgatttaattgtctctattgggatgcagacacctttaggcttttcccatgctgcagaagagccagacaaaagctttttctggtcatctgggatcttgatgatgctgccaagaggcatactcagtgtctctactcattgagcttacagggctattcccctttctcagaagccatgtgaccagcttgagaaagtgccaccaacacagcagcatcataaggcatgtagaggcactcatatttttttaaaaaaatcaaaccaagaggacaagggtaatatagaaaatggttaaaggtataaaaatgtgtaaagtcaatttatatcaaatatttattgagcaccgatggtaaggttctgggtcataatctttaatattcagaacagaatttgaaacctctcccaattgtggcagaagtttaactgtgtgtataagagtccagctttctccatccatttgaactggctttgggaagaacctgggtagcagactttagggacactgatgatgccacgatcacccaagtgttgagactgagaaggcttcaccgtgccttctggtttaccagcctacttattgttcacccctttcaaagcccaaagcaagttggactaaatggcttacaaatttcttctcttctagaatggtgcagataacagagttcctaactttttaaatgtatatactttattttcaaagaactctcactttctacccttacttccttgttttttttttttttttttttgcgggaggcagtgaacaggaagagatataataataagaaacttgtatgcctacttcctaagtaagcagatgttctactgaaagaggaaggggaagtttggagtcaaatagaaaacaatggaggggactcttcactctattaaggaaagtataatatagtaattttggcaaataaaattgaagtagtaatgatccttctccatcatcaaatttatcattagtcaaatatggtgaattctcaattatctaccactggggcatgactgtgtgcccaaagtccaggaaaacctcaaaattccatctcttatcatagtctgttcccattccattcccatcacaatatcatctcattggagttgctaacagactgtatataaaacgcacttcggatttacttctctctatctgcccggtctctggttgggatttaacaaatgtctgaaaggcagctggcaggaaagatttgggtaatacagtgactgaaccatcagctcccagataactgggtgtgggctactgagttgatatacacagcagaacacttttaatttgagtcatactgatcaagcataaagaagaccaatgcttttgccattaataaccctcctggtttaaaggaggatgaaatattgacagagaagcaagtttgccaaatggaatagctgtaaatgttttccagggaagtttatcaactggcatcatcacttgattgagtaggtcttgccaagatgaacacagagatgtgaacagaccgatggggggactgggattggggggtggcaatgggggaagtgaaggaagctgggtttcttgataggaaaatgctttcggacttggagcaaggtaccagggtgggcagggaggccacgtgcagattaaaaggcaagccagatggagagaagttccccccaaattacccaaccccacacccaagaacaccaaaacaaactctaaggaatctagcgatagcagcagcacagcctcattgcgctgagcaatttagaaagtggaagaaggaaggaagagaagaaggaagggaaaaggagagggaaaggggagggggggaaaagcaaaacaaaataaataaaaccacaaacagaacaatataaataaaaataaacaaaccaataacagaataaaatttgtaactcctttttttttaatttcacaaaagttttcacaaggacaacgttatagaagaaaacccccagcagtggctaggtcatgcagaaccattaattgtcataccttggcccattctattcatccttgttgcactttagagagagaagtaagctatgtgagttttacaatgcttttaaactgtcatatttcctgttgagcactttaactggcacattcttatagttataaatgttctgagggcgtaactttataacctcctttgcaaagaatgcatgaagagctcttcatgatccaatactaggggatacatatatatagttatatatatagttatatatatataattatatagttatatatatataattatatatagtttatataaagagatagttatacataatataaatcaatatatagagggacaaaaataatttgaaaaaattcttccactcatagggcttgataatttacatgtatacaattattccccaccacaatactggtttgaatactacgctgcccctgtctttggtgtgggggagggtggaggttctgactgagcctcaccatttgtcagtaaaagtgcttgtcaattcacacagcaagcaaatatccaaaactatcatgcttgaggggacgggggatccaaaatctaaatccaaaacattcaccataaaaacacctttttagagatggtacagctgtgacatgttttcctcctcccttttacccctattctattcgatggaattctttgaagtaaaacttttcaaatatgtatataccagcctagtccatccataagggaaattggttatggtgaattggccagtttttaagaaataccgcactgcctaaagcatgatttgcatgcacaaagcatctgacaactatatgttgaaaaaagggtatttttctacctctcctctcatgcttactaagtgttaaaaaagaaagaaaacaaaagaagaaaaaaataactataccaaaatgtgtttggctcactgttgcactcttcttatcccacgtctcataatgacaaggagcagctctctattgccgtcattaccctgcctaaattggctacattaaagaaagtgatgatgaggaattccttcccaccagctttctgcattgggacagccagcaccgcacagctgtgccaacagttgaaggtggtggctggcttttgtctttgttgagtcaactgtggctgatcctcctacattctaatttatttagcatgtcggctcctagaaaagcatgatctgcagctgggtttgtcttcctctcactctaccattgccccagcccttcctcctacctggcattggggccctaactaatcaaacaaaggggagtaaaaagatcccctgagaatgcatggaaaaatacttgctctttcctgagcattatttattctgtacataaggtaagtaattcaccttttaaaagatgtaaaagtcccaggaaggcagtttttaatgacttacatctgatatttatgatacatatggcttttcatcccaaatgtcaaaagtgaaagaaaaaaaatagctattcatatggcaacataaggagacagaataacaatttaatatgcaatcaaacctcttttcacttaaactaaatgactagaatttgatacatccatgattggaatactattctctcctccatattaaggtgagaaatgttcataagaactcccagagggaactggctctgggacaaaaggccttggtgagtaactaaaaaaatcactgatgttctcttgcaacaagcaggtccttcataatcatctacacaaatcgtgaaagcttttcaaatgcttcgcaatacttcggcccagagactggaaacaatcaatatgttttcattgctgtttggttgcttgtttcaaataaacatgtgctaacttattgtgtgtataaaaaaagaaagaaaggaaaacaacaacaacaacaaaatcaaaacccaaagcaccctgataatcctgataaatcagaatcaacttttcttttacattaaataaacttgctctgcctaactgacgttgatcacaagtgctcccttctaatctgtgaactcgttcctgcagtgagctatttatgtctggagcatgcctttgggttatttttcccccagaatcataaataacttttggtccgtctgcttatttgctgttgtgctcaagggttttatggtggtgaaataaaaatgacaaccacatgcacactatcatacatatgcaaatatgtgtaaaaaaaaagggggggactacaggggaaaacagggaaagttactttgttggaaacaccaactggggaaatgagtggcagatacagtttcacacagtggcggtggatacacatatcaaagccgctcttcctgcacgtacttctgtttgtcccgggactccctggacttgggccggttctgtcggtttgctgtggatgggatggagtgaacagaggagctcttcttgctggaggactgcgacgagtgggaggaatgggacaggctggcccgggactggccggcattgtggtcaaactgcattaagcagaagatcaggtccgtcggcacgagctcaaactcatagggcgggttggtgatgacatacctggacagggaaagcagagatgtcacctcctgagagtaactgagtaaagaattcaactctctctgaaccaaaagcaatggcctggttactcaggactttcagaggatctggaagatgcactcctagctggtctgaggccttaaacattctttttcttgttaaatggaaacttcctctgtttaactcaataaaggaggccagccaggagcccaggcagagatgtggaattagagccagtaatggaagaaccaaacttcgcttctcgtggtctacatgtacctttctatacaaggtcaaagtcactttcaagtagcccaaccgcaagaggtttcatgaagtgtgatgcaactttcatttcataattttcggacaatcccagatatacatcacaagatctttgtttaccatgacagagtgtctccttagactattctcgctctttaccttttaaaatctactttggtgagagaatttggaatttggaattcaccacatggaagaatctaagaaacctgcctacttatcagcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacataatttaaaatatatatatgatgttttcttccttccagaccagttaagttagagtaatcagaatattttttaaaagctccccaggtgattctactatgcaagcagggatgagaaacgcttgtctctgcagcactgttgcctagggtatattatgcaaactcactgatcttggtaattctaggatgtacttttaatttttgcctgctatgaatttattttaatgcatatgagaaaaatataattggcacatctaaactgttatttctctgcttaaggtgataatatataattgtctcaaaaataaatatataaaagttaaaaagcgagtcaatttaaaatatgtgaagtaaaaatatgggattctgagatatggcagaagaaccacttatcttagggcggggtgtggtggctcacacctgtaagcccagcactttgggaggccgaggtgggtggatcacttgaggtcaggagttcgagaccagcctggccaacaagccttctctctactaaaaacacaaaaattggctgggtgtggtggtgtgtgcctataatcccagctactcaggaggctaaggcaagagaatcactggaacccaggaggcagaggttgcagtgagccaagattgtgccactgcactccagcctgggcaacagagcaacactccatctcaaaaaacaaacaaacaaaaaacaaaaaaacaaaaaaacttatcttaaacactagcaatgtaaaatatctctatattaggtaccaacagatgttatcctagtagctagagtttgggagagatgtttgtgtattcagacttttgtaattaggtgatggaattattctattaatacaaaacttgaattcttaccaaaatgtctttacatctactattagtaattatagaaaaatgcttcccatcacctccaaactcagtgttggatttaatatgggcagagtaatttgcatgttgaggagatgtatacagacctttgcctttacagtaggggacaggaaaggatattaatatttctgtgattaggtgggagggcagagttgaaaccaatactcacctctttgtgcactgactgggggtgctgaggtgagcatctctcagccggtaaattccaaaacaaagcatattatatgttttcagagctttgcagaacagatcaccataacaaccaccatcctgggagacagcaaaagaacagagagaaacatcctttttatttgcctgaaaatcaagggacagcagggaaacgggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagattatgcttctccctcactttaagtcaaagtgtaaagcttgatggtctcagatgtatgctcagctgaggagatgaacccttctctgcaaaatggtgattatgttcagtcccagctcagctgtaaccgctgtgataggctcgtgttgtcaaaactgtctgagtgataatgaaaaccaccgcaaggaggaggaccccaccaggtcctatggtgacagactctttcaggaggtaaggaccctgtgaaaagcacaatttacagacctcagagatggcaagggtgcaagagaatgtgtttccctaggagccaggggtctgcaggctgaataactaggattcgcagttctgatcagttcacagccaccttcccggggtctggggcctgatgcagaaagtgaaagcaaatgcatccacttggaaatgctggcttcagcggccaggtggcttcaggtagatgttacctgtattatatgaagggcactgggcactgcgggatggcttcactgggtataaaatgactgtctttgtccttccaatcattggaattctcatattggtctcataccaaagaacactgatgggaccaaatcttaccattatctaaagtctttatcctaatcaagtgcatcaataagtaaatgataggtataaagagccactagctatgaaaattccctttcaaaaaaagcctagtctaacataggtcccagtccatgatcaaactaaaatatggggaaagtatgcagcactgtttcagaaaaaacagagacagaccctttccttggctccttttccactatttagtctttctgggcgacaccattgtttgtgtaacaggtttatcagtttctgtgacttatggctgcatctcttaaatgcatctgtggggttgggctgggaataagggcaaagacagcacacttctgtcacagtgcctacactaggcagatacatggaatcagaagggagacgctggccacttccgtcacagggaggacatgagggaacgtgactgggtccactctcagaaattacaaggtctaggttttgatttacaggcattaaaggatccacataagattcggtttgtttggccggtggttctggatacatctgactactgactaccctggtgctttgaaaaccaccagtgcctgggtcctattcacatataaaaactaagaaacctgcaggctgaggctggccacctccatgtgctattaatgtatagttgggttgagtatccctaagctacgctaagagcctgtggaaatatttcccaaccttggctgcatgctggcatcacctgctgcttctcaccttgtgcagaggatacgtgaagagaacaccaaggagggagaaagcccactggctctgaagccaggatgccttggtgcaaattcccaataggtctagtgctcattctctctgggcctcagttgacttagaaggtgtgatactagaacttatatcaaagggttgctatgaagattaaaatgaatgactatgcatagagcaaagtgtctgatccagagtaaactataaataaatatcacctcttacagttatctacaataggaaggagaaaagccagatgcctagcttgtcacatctgataccacgttcttcaggatcaagcttttcccaaacagcaagctcaggtgacctcggtgctgtggactcacccctaagtccgcaaatggcccatcgagcagagctaactgggccacgcggcagcggtccctattggccagtgtctgcggggtgctgtagccacctctaagggcgttttcctcagcaatcagagcctccagctccggcgtggctcctccggtcaccagggtccgtatcagggtgaggatattgtcattgaagtacgtctggggaaggagagaaagtgagggaaaagtcctttaagcaaacaccctaaagtcatgacagccgacatccaaattacaacttttcttggtatctcctgtttaaagttctggcctgtctcttcaaataatttcatgtggggagtgaaaagacagcagcctccaattattccgttattttctctcttgcttggctctgctacgacagcctgacttaaaaaacccagttcaggggattttttagtaaagggctcaaatctgaataattagtgtttgccataattggttttagtagggatacaaatattgcctccccctcctaaagtctacgtgactactatgagattctggacacgtgtaataaaatgcagcctgccccagctactaacccaagcagcattgtctctgaggccctgtcatccatgtgccaggaagcttcctccccacgacaacggcaaaacctttcattaatgccacacgcttaacgatttaccacatgcgttgataactgtctaactcagaaatctcgatcaattaaatatgccggataaatttatgaaaaggtgaatgtcctggtaagtgtactttggcttttgttttctaaaataacctcagtagtctgaggcaaatatcacttattaaagaagtttccctctaagtgtacatttgtgtcacatctgaaacataacagatctgtcaggaacaaaagaatgggagtttaaaaaaaattaataggatgtcaaataaaggagctttaaaaggtatttgtcaccagcctaatttgagaaattctcaggtaagggtgtgcattccattttcctatgtaagtagaaatcaagcaggctaaaaaactcaaatcaaagtttgcctgtggcttttgaggatgcactttggaaagaggtaaggaaagatgcaattgcacctcagcagcttcttagagagtttagctggcaaggcatagtagggaacaaaccaagtaagggtgagctcaagttcccatcccaggtttgctaactagttctatgtcttggaggttgcctagtcattctggactttgatttttctcgtctgtaaaataacagtggtcattaaaaccaaatttatattcacataattccatgaggacttctgaattaagatgatagttactagcggggctggattcacaatcctcattgaaatacttacaaaaacacccattgtgatacaaaattccaactgcaaaagaatttaggaatgttatccatagcctgccagaccctaaaggaaatttatgctcagagttaagatatgcccttaggcacagaagcagaaaaaggatacttaaagtaggatatgtttctggagaggttatgggatccagggatccagagctgggctgaggggtttaatgctgacttcacctctcagaagctgtgtgaccttggaaagttatttaacatttttgtgcctccgtttcatgatctgtaaaatgtaataatagaaggctgtggggctctatgacctacccatgaagcacttagaaacatgcttggtgcacaggaagcactgataaacattttggcctcatatcagagacatgaggcctttgccaagtagaggaacagtcagctccattctcaactttcctttgaatttttaatcttctttgttttcttggaggcgtggggaactcagggctttaaaaaccaagcaagggattttaaactcgatgtggtagaaaatgggaggtcagccaagcatggtgcacacctgtaatcccagaactttggtaggccaaggtgggaggatcatttgaggtcaggagtgaggtcaggagttgggaccaggctggccaacgtggtgaatcctagtctctactaaaaataaaaaaattagctaggcatggtggcgggcacctgtaatcccagatcctcgggaggctgaggccagagaattacttgaacccgggcggcagatgttgcagtaatctgagatcatgccactgcaccccagcctgggtgacagagtgagattctgtctcagaaaaataatgaataaaatacttagaaataaatatattgaaggaggaacaagactggtatactgcaaactacaaaatattactgaaagaaattaaagaagacctaaataaatggacagacatcccatgttcctggattagaagacttgatttattaagatggaatactaccttaatttccagattttatgtaatacctatcaaaatcacaaagtccatttttttgtaaaaatggaaaaattgactctaaaactgcaacagacccaaaatagccaaagcaatcttatagccttataaaagaaagacgaagttggaagtttcatacttcccagtttcaaaacatactacaagactatagtaatcaagatagtaatggcataggatagacctatagaccaatggaaaataattgaaaatccagaaataaactcattcagttatgatctattaattttcagtgagtgtgccaagaccattcaatggagaagttaatatagtcttttaaacaaatggcatagcaacaactgggtatccacaggcagaagaataaagtgggacctatacctcacactatatgcaaaaattaacacaaaaggggtcaaagatctaaatgtaaaagctaaaactgcaaaatgcttagaagaaaatataggagtaagtctttatgacctttgatttggcaatagtttcttggacatgacacaaaaagcataaactacaagaagaacagattaaattggacttcataaaaatttaaaaaatatttgttctttgaaggacactatccaaaaagtgaaaaaaacaacctacaaaatgagagagcatgtttgcaaatcatatgtctgataagggtctaatattcagtattaaaaagccttttataactcaaccaaaaaagacaacccaattttttaaacgggcagaagacttaaacatttctccaaaaagatataaaagtggttaataaacttatgcaaagaggctcaacagctctagtcatcagagaaatgcaaatcaaaaccacaatgagatattttacacctactagaatagctgtaataaaaaagactgatgataataacaagaattggtaagaataaggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccgcacttaatcggttatgttatctatagattacagacattgtatagaaaagcactgtgaaaatccctatccttttttgttccaatctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagaaattccactcttacagtatatacccaagataaataaaaatatatgtccatatgaaaacgtgtacacagatgtttatagcagcattattggtaatacccaaaaggtgaaaataacccaaatttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagccgcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcaaaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagggagtgtttcatcccttatctgcaactccataaggcagacacccccagagcagccattttagaggctcctcctgggaatgcattcttttcccagggttgttaattattaatattccttactggggaaagaattcagcaatatttctcttacctgttttcagtaataagagaaacatggctctgttccacccagcccacaggcagccagactttaaggttatctcccttgttccctgaaaattgctgttatcctgttcttaaggtgcccagatttcatattgttcaaacacacatgctttagaaaaaatttgtgcagttaacggaatcatcacagggtcctgaggcgacatacatcctcagcttacaaagatgatgggattaagagattaaagacagacataggaaattattaagagtactgattggggaagtgataaatgtccatgaaatcttcataatttatgttcttctgccaaggcttcagccagtccctccgtttggggtctctgacttcctgcaacaagagtctatttatataaaatatccagaaaaggcatgtctacagaaataatgagtagatcagtggtggcttagggttggtgggttgatgggtggagttgtaggggagggtaggataactaaaatacaaagtttctttttgatgccatgaacatgttctaaaattgactgtagtgatggctgtacatgtctgtgaatatgctaaaaaaaaaaccactgaatcgtacactttaaatggatgagttgtatagtatgttgtgtctcatttttttaaaataaatagttaaaagacaactaaatttgcactggccaactttttaatctaaggagccatgagtattagaggtgaaaattacacacacacacacacacacacacacacacacacacaattagtgatacggaagtaaaaccaggaagttctaagctaaatagagaaagatatagggatttttgtttgtttgtttaataagagtgctggttgatattgagaaaaagacaacaaaggtcaagtgataaacagtaagtatttacaaatcaaagttgtaaacaaaatgcaagcgtgtaaaacaagcaaacaaacaaataaaaataacctgtcctgagctgggaaatgaatctaggatgcagatcaaaagcattcagcaagttaatgtggccaactcctagacctgtactcggtgaatatttgaattcaaaatattaaatggagaataaaaatgacctaaaacaatgctgtaagaaatacaagtataaaataaggctaggctgaagcttctctagaaaatgtaagaggaatgtcaaaggaattttgacaggacacatttgttccaaaaattctacatatagttaaattgccaataatttgtgaaggcaactgaaatattttttgactctttgcgtacataagcatttattgatttaatttttttaaatacttagaaacaaaaattagcttctttaaagataattttaaacccttagtaactaaaatatgagcaaatttggtttactgttaaaatatatttaaaacagaattgtaaaagattattgtatatattattacaaaatggaatgcaaatgtcaaaactaattattaaaaaaatgacaaaactagctattaatatagtattgctaaaattatgttttaaagttagaaaaatgagatgagatagagatgatgatggaaataaaggcatgaaaattgcctgatcttatacaaggaggaatcaagaactactaaatttttctagacaataatacttagaaaatacatctatagaatggctggtaacaactaactagagttaaaaatagaatggaaagtttacactacagaaaataagcatacaaaatatagtccacataccaaaagatggatcataaaacatataattatgatagaagcatgtaaaaaacataatgcaagactatagcatcttatgttatataactaaacataaatgagctaaatgatcctataaaatggcaaagattttcagacttgttcaaatgccaaaatcaaactctgatatctttaaaagagaaaaagggaagaaaaaaagtatagcttcaaagaaaaattttaaactattatgttagataagttaattttatattcatagttgacacaataaagctataattttttatggacaaatattataactgaaatatagaaagcaaaactaattagaattacactagaataaatctggactaagggtaatacgtgaaatattcccactatcactgtttttagcttttacaggccaaatagatcaaaagataagaaaattgaggatataatcaggttgatttagtgtatttttactaaactttgtaacaacgattacaaaaaaaaaaatcaatggccaaaaccatcaaatctcaatacatataacaaagtataagctgtataacctacattttaaaaattaaatacaatgtaatagaggcaaaagtaaatattccagaacatcaaaaaaattttgttaagtatcctataactactaggtcaagatggaaatcaaacttagaatatgaaatattttaaaattaaagaatatttgagaatgacatataaaaatatcatgtcttgaggccaatgctatagagacaaattcagagcctttaatgctattattaaatacaacagaattataataagtaaaattaagtattaaaagaattctttttttaaaaaaaagcaggatgaaaagtgtcagttaatgaattagcaagaggatatttagtgaattgttaaattcaagaaataattccttgaaaaaataaacttatgacaatataactgaaaaaacacaaataaaattagaaataaggagaataaaatgtcagatacataggagaattaacagtattattccagatactctctttaataccaatcactggacgtgaataagaatcgctactgtttttaggcaaaaagcaaagtagtaatcatctatgaagagacagaggagagtattaggaaaaaaggaaaattccatgttccttaacatgtaaataggccatttaatgtcattttttccagtaaaattgttgtttgacatatgtgtaattgcagatttgaattggactttttaaaacttgataaaattatgctaaatttcccctggaaagagttgtacaaaattgtcctctcatgtagtatagtaaattttaaaggtttcctaaccaaatattgtagacaatgtgaaaaattagaagatcaaccagaatggatttatgagaaccatagcttagtagttataagaccttaatacaaaagttggcaaatctggctcttgggccaaatcttgctctgccatccattacttttttaaaataaggttttgttgggacccagccatgtccatttgtttatgtattgtctggggctgctttggtgctaacaaactcagagttaagtagttgtgacagagactatgtggccctcaaaggctgaaaatatttaccatctggctctttacaagacagtttgctgatccattccttagtataacaaggaaagcattgcataccacagggaagggattttactcaatgaatgatttgggggaaactggctctctgataaaaatttttcaacaatatggtaatgattaaacaatggttctttgacatgactcatattgtacagacatgaatattgtgctttcagataatatttaatggcatggtaataattatataatactaaaatgttttttaaaagtaggatccccaaaacaccatgaatcacaattcatgttaaaaatgcatacctgcaaaactattggctagggaaattaactttttctgtatttaaaatttaattttaagagtacccacttttaaatattgaatctttatggtactgggttttaagttttaatattacttttaattggctttttcatactaatgattccttttaatgttttcaattatcatatgtttataaaatgtagagatcatttttattattaaactttataatgtacactgtttcataatataacaaatcatgcacttattactttttgaattattttttaaatataaatcttcaatgtttaatggaaagttatcagaaaatgatatcctgtttattattatggtcactcatttatttctaccataaagtattacaaaaagtacataatgctctgatttggggacttccagagggaaaaataatgcatacctgaactgatagacgtatttatgtgaaagtaactgtaagtagtacacaaaatttctacttagtagttaattcttggttttagaatttggggtttttttcctataattttattttatatattttctgctgtgaaaatacatttattttaaatttctgtaaaaaagaaagtaaatgttactaaatagttaaaggcaaaaaatgtagccacaaacaacttcacaaaaatatagcaaactgtttaatctcaagatgcttgatagttctcatgttcagcatgcactttttatgcataaaaactgaattcactatataaaatatgtatttacatcattatatacagattaaaaactgatatgcttcaaaactatcataaacacaattaaagggcctcctaggaaaaatgacaatcggcatttgccataatgtatgagatggctcagtatgacgagagtgtggattggtaaaattgtttcttggagatatcatgacaatatgtatcaagaaattttaaaatgtccctatttgttaaaaaaaaaaaaaacccagtacatttgcctcaatataataagttgctacttgttcaaagatttatgtacaataatttttattacaggattaatcattgctataacaaaaattttttaaagctaaatagccaaaaatttagtgataaatcgattctggaacatccacagactggagtctcataaagtcctatggaggctctgcaaatcatgacacctaaggaaataataaaatactctggataaaatattaactgaaaagggaaaaaataaccaacctataaaatgagataattctgtatttatccatccatttagaaggaaagacaccaaaatattaaccatgcttatccttggtgttggaaacataggccatttatattttcttctttatatgttttctttttatttttatatgtttcttctttatatgtcttcttttatatgtttctgtgctttccaaattttcatcaagaagtatgaataactgttctaataaaaacacagtcaattttttttaaacaaagggcactataggttatccattgcaatgataaatctagaaggtcaggctgggaggttattgttttgtcaaatctttgggatttgaccctaacatgttcccacttctgtgttgaaatcagttatacccaaatctttttgatcagtcactgacatttattgagcacctactaatcgttgggccttggtttagcctgaaattgtgtgaaagtcaaagagtgcatgacttttagaattgctcatcaacaggtacaatttcatagtcagtcccagggtttcacaggtgtctgaacaactctgggaccactcatatctctgagcataattgtctgctctctgagctggcactgcatcccagatgatggctctccttgatttttccatgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctgggttaacataaatgctaaaattgaagaaatgaaacattctaaaggcaggatcatgtaggtgagatcctttgcctcctaagcttttgtcctgccagtcttttctgtgccttaccatgatacctgtgctagaagtcttctgggaagctcttgtatagaacctccaactctggcagggttagtcttcagggatgcttcaggcagagaccttctcaatatctatccttgcgtcacatgggcattgagtataagacagctgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtgagggatgaaaatgattggatttttttttccctaccccaggcctgcctggcctgatgtgacagcagtggtctgtcctgagtctagcaggacatacctccatgtacccgactgacaccactgctagctcctctgcctcgggacggccatgtgccctctgtctccgtgtgagcagttgaaatggaggctcttgagtggagtgtaagaaatagggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatctaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccaattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcacgcttctcagatgtatcgtacactagcaaaaggggcctctgcttttctctgctctttctcttaacactgttataatatgctttttctttatttttccagattaggtaggccctgcaaacctaaagcttcattaaatcttgttttctaaaaaaaaaacgacaacactcccaacttgtgtgcattggaactcattagctcttgtagtagggttcccctttttctcctcagaaggaggtggctcctcactgctccttcaataacgatggttcagtgtgattggtatctgtttaggaaaggtccaaggctcaaggaaaatggacatcatgtgcacaacctcctaactcagaggacaagcaagtgaccggaaggccaaggatgctgtctgaccacagacattgcaatgcagacacataagattagaagcaaaacgcaggaggctggtaaggccaggacagtgggatgaaccaagcagggaagggacatgaatgaagcaggcctggtgggatacaatagagagtagtgtggactgtggctaaagggagcagctgctcagctcaagccaatagctgctttacgggaatctgggactctgccttctgactctaatttaaagaaggcaggaaccccgattttatataaaatcttattttaaaatattggcaacaaattcaatttaaaaataaaaacttgataaatgcagaagttgtctgtggggtagatgtagactgcaatgtgacatttcgagacttctattacagatcttttattagaaacaagatatcaagccaagtactatgccaatatattgtgctatttcttcttctaaaatgagtgcatgaggatggggtgttggacaaaaaaataatcaagggttgcgcttcaggaatcaactcagtgatgagctcactgtcctagccagcgtatccagaaacagtggcattaggaggaagctggtggctttcagaagaaggaggatcctctcgccaagtctgaagtgtctcattccagacttagaacttggccagatgtggtctattgtactcggaatactcagtgtggccagcggccttgccttcttgattgccttcctgtctaccacattccaaccataatggcctccaactgcttcctccaacaaaccaaacccagcttgtcaccactgtgcagctttggcctttatagtgttctctccctctgtttttttcagtgtcagcttcaatgttacctcctaggataattttactctgaccactgagggtaaaacaggtctccacacccattcaagctatttcatgttcttcaaatcaattatccttatgtgacactattcatttattcacttacctatttactcttaacccactagaatgaaagtttaaataacatgaaggcaaggtcttcatccttcttttttacaactgaatccgcagcatggggaatcatgcctggtgtccagtaagtgcccaataaatgtattgattaaaaacactagcaacaataaatacatacagagcttgtcaagtgctaagcaccgctctaatcgctttacaacctttacccatttactcatctctgcaaccctgtgacataggtactattactatcttcattttaaagatgagaaaactgaggcacagggaggttaaggttacccagccagtaaacagcagttctggaatccagatctaagccatctggcgcttgagtccatgtccagtattcacttttcagggtccaagtggagcttaagttggggctggggttgggagaaagtgatagctggatgaaaaagaaatctgaatactcatatgtgagtctcatccctaaaaacagagaggattcctttcacctggtgcgactgtgtgcatcaagatggtatcattctgaaaaatacatttctaagttgtgatcttcttagagacatatatccaaaaacctaattattccctctcatcctgtgtttctgctgttgatttgtgagataaagccacagggccatgtctgtaacatcctgatctgttccaggaatgcctgtgatgaatcaaaatattattcttttaacaaatgaagcagtaagcagcaggagttgggttatgaaggacaatattcagagaatgtttagacacatgattaaatgacaatttggggaggagcgctagaataaggagactgtcaacagctgaagagatttgtgtgtggatgttgtgatgttgcttatgagtgaatgcctgcaatgaaagtttacctctgtctcctgctgtttggaggagtctcactttctcaatttatattcatgacagccctttttgttccttctagttactgccttggcacttgactaatctgttttttcatacattaaggttggggtagaatgcaaagaaatcacaggtaacattttaccaaaacgtctggatccaactagatttgtggactcagaccctactcaagacctcattatgaagcttgttcatcctagacaatgaaaacaagacctggaataatttgataggcattttgattaatgatttgaaaagttaccatcaatgacttacttaaatatgtcttgcttcaacacttaaaccaagagtattcacattattgtccaaaagattcgatagtgtagctaaagtgcctcgcacagttctgggcccttagtaaatgatgctcctgatgataaatacaatgacagttaccagattcctgatacccttttatcctaggctagaatgcagaagacatgctgctcccatactattgcatccaaacatgccttagtcacactatcccaaacatttttgtgtgcatttcaaaggagatgagagatggcttgtttaaaaatttcaaatcaattcactttgaattctcatttgaatttccaagaactgactacctactgatgatatagatgcttgtgcaactcaaatccagatgggcccccacctccaccctgtggctaccatatgcccctttggctgtgttgaaaagaagttctccagtgctcaaaccgattttattccttggaaccagggctggtttcatgggtgttcagcctatgtggttgcacagggctgtactcagacacatctctgttgttttattttattttattttattttttgagacagggtctcattctgtcacccaggctggagtgcagtggcgctatatcatctcacagcaacctccacctcccaggctcaagcgattctcaggcctcagcctcccaagtagctgggattacaggtgcacaccaccacacccagctaatttttttatatttttagtagagacagggttttgccatgttgcccaggctggtctcaaactcctgggctcaagtgatctgcccacctcggccttctaaagtgctgggttacaagcggtagccaccgcacccagccccaagtctcttttgttttaatactctgctgtcaccattttgaaattcttaataattcatgaaaagtgaccttgcaaattatgtagccagtcctgctagaaacatactaaatatctgatatgtagaaacataaacaattttataaatttggaattttaaaaatgttatcagagtattttgtagttctgaaaaaaaaattctactgtaaatagtttaaccagctcttagaacagtcttctgagatctctgtaattaggatcagaactaaaataaaaatttctaatgagatgaattaccaaaatccatttgaaactggatttgcagaatatgaggcctatgactgagaatatggtcttcttaggaacacatcttgaggcttctatcattccttctggcttgctcaaggagtttgcccaaactgagcccaacatcactagcaggtagaaaggttagccttggtatcatcaggccataagaaagatcatgagccccaggaaaccaagggagcccttttccaaggaccattttatctccttgttggcttggaaagccatggcatggcatgaagcccagttaaccttaattcagacgaatgtcatttcacagtcatttttaaatccaaaattctgatttttaaataagatatgcttgcagttggacaatgttcaggcatacagaataacccaaattagtcttaaaaagctttatgttttttctttcctcaaatagaggtccttctgggattagcattatttaatgaatagatgagaccagtacataattagcatatcagttgtttagcacattcaggagaataactttcagcactttaagaaatatacgtgtgtaaaaactctgagttctgtttatggttttaatgtgttcagaaaagctctttatcatggattctccaaaggtcaagtttttgttcagcctatgtctgcattttcacaaattgagaatttgagaactccaaaatgaagaagattttctacataataaataaagatgctcagtgggaagacttcataatacccaggttatgactcattctaaatgcctacttttgccttttgcagtgaaagatggctccataatgttgggacccattttttaatcgttatttgtttttcggttgcaaaagtgaaaaaacaaatgcctgattgctagatgcacatcaagttataaaagaaaccaaagctgtgtttgatccctgggccagcccactgtcctctctctgccactaactcctccctccttccagccaggccttgcctccatgcctggttctctcccaaggacttcagtctcagtgacaggcctggcagtcatctttgacccactgtcctctccaccttctgctcatgctcaatcttttcccaagtcctattaattgtactgcccaataccactgagctccatccacctccctcgatcccaacaccagctctatcctagtccaagccatgacagcctcttactcagacctcctgccgccatcttgtacctctgaatcatcctccctacaacagccaaggcaatccccttaaagcatgaacctgattatgtcactctccaactaaaatccttcagtgcctcttcattattcttaagaaaaagtccaaaaccatgaaaatgtgtttcaaggttctgcaggtctaaccttggccatcctcctgcacccttgtctccccatggtccagcctcacagggtttctttgccttctttgagagcctcaggtcccccccaacaccaggttttgcatttgctttctttcttcttcagagaatgctcttcccccaagatctcccctctttatggctcaaattttagcataaaatgtacaactcccttggggaatttttctgggatccccaaaaccaggtcaagccctcacctatatttccttctagcctgccttgccttccttgcacttgaggaatttataatcaaacatttacttgtgtgatggttttataatgtgggtctccccttctaaggtgtgagcttctaggagtcttgctctccactgtggccccagtgcagcccagggcctcaaaggttggaggtgctctattggcacatcctccacccttgagtgaggaggagggaacaggataactcaccgcgctcatgagtgagtccaggacactgacggcaaatgctgtcccacaggcaaagggctgcgtgaggtacagttctgtatcagggtcatcatcatcgtcttggtccaaaaactgaacattagtatcgttcactagaaaaagcataaaataagaattagctctgaagaccacacacaggcattgaagccagagggagaccaggctactggtttagaaatactgaagtcattgagaaggaaacaaaagcatggaataagctgtagatggatctttgggtaaggggggcagtgggactcaatggactgttcctgtgtcactgtttaagtgtctgagacctggagagcaataagttcaagcaggcttgctccacggcaggccactggaggaccaatagactgtgctggccagtcctttggcatagctttaggatcatgacctaaaaacactttccagtgttttttggtaaccaagtcctttgagagatggacatatttcaatgatgagcagccatgctgggatagtcattttagccacaatgaaaagaaagcagcttattgggagtaaagagcgctggaaggggagcacagcaaaggcagatagcaaggaattcagccacaggcataacccgcagcctacccactgggattggcctgggtagttcccggggtcccaggccctaaatctaggtccacacccaataggccctgtttaatacacaggaaaccccaggtgggatggatgcctggctgtctcctgctgcttgctgacaaggacttgctctgaattttgagttgcatggggacgcccacgttctccctttcccatcctaaacagctcaatcttttatatgcttgcattcaagcagatgcagcattggatgctgtatttcatttccatctgaggattcctcaaggactcctcccgcatgtacgtgcaggctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttttaaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagcctgtgctgccaacttccttgggcaaagcatttcatcattctataccttagtttgtttctgtaaaatgggggagttacagcagctctctcatgaggctgtcaggaggctcatacgaatgggatggtgcccagtaagcctggcccagcatctggatcatgccatgacttgataaataccagctgctgtcatgatctcccttctgacattaaatacctgtccacccattatagcatgaaaatacccagcttccctctgcctctcttggaaacactgaaggtcttgctcaggggtctttcaagaggtagcttttcctcacctcccttcacttgtccaaagggatgttgtaggccactgtttagtctttctgttttgtgaatcagaaaatgtaaactggagaccacatatggaagaatgcagttttagttacttgtaatagccaccaatggtgtgtgtggcaatgctccgaaaagcacagcatctgttacctcttatcaggaagatggggaagggttggtaccagatatggaggtgaagtgactccaagtagggggaggggactcccgattgccagtgagctagacatctggggtcataggaaaagcgctccaagagaccagccagggtccagtgaataccttgtataccgttctgaaatacccagtctcagaaggagagcaagcaatgctactcaaggcctatttcacagaacagtaattatgtgggtgctaagaggtacccacgtaatcaccccaaagcatatgtggtcaaatacaattggaatagtcaggtgaaacagctgtaacacagtcctttcttgtgagactctgaggagcctttgccatgctaacatcaattgagagtctccaagtagatgaaaagtggaatgtgctacacagctttgaaagcttgtgtggccttggtgccctctgtgtctcttaaaattcattatactggcctggcataatgcagaacacatctcagaacatgtagataaataagaagtatttgtgggggatgtgggaggtgaaatggtctgaggagggtggtatagtggctagagaaataggtttcaaggcagaagacaagggtggtgtgagcacctgaaagattctctgaacacaaggaagaaatctggtgtgggacaaaggcttcaggagagtcaatgatgctaatcaaataccagaattgttgccttaggtttggggcaccaagcttttccttttctcgtctactaatgacaaattaagatatcctagttagtcagcggcacgtgaattccaaatagaaaatgaaattcccggcagtgaggattctgaaatgctgctgtaggtttgtgagatggagatgtttggattaattttccaaccagaggcgtggaccacatgagccctgggtctcttattgccctccagttctgaggagagcaatccagaaacctagggcttttaaacaactacactaaacatgaaaaagatacccctcctatggttggaaacagaaaatagtgtgatactccctgacctgagtgaatttgtcctgataaatagctatacctacaataatgcactgctgagtggtggacaatttattccttggtttctagacatctcgcaagcaagattactgtgttgaaagcctgctcccttattttgaaatatatttttgggccaagaaaatggggtgttcatttcatttgtgagtcatgtgaaggcaggtgctcccacctctctatccacccctctgctgagcagcacttttgctgtctctatttagaagatcaatccccagttctgagacttgctgctgatgggtgcccttcatggagttattaaccaagtcacggggaagtggggaagaacctaacaaatgcagtcacgactggaggcctttatcgtccacctgagtccattgtgaatctcccagagaggattctgggctgggattgggggccagagtgcagggctgcacgtgggtggctgctaaccttatcctccgcacccttcttgaaatctgcctttagtaaaaaaagttctcctagggaccaggtgtttttatggcttcagaaccagagcttctgagaaatgccctagtaggggggaaaaaaaaaaaaggcaaataaagtcagaataaagaaaaataaacagctggagggaaagtgccatcttaggtttcttatcttaaaattttgatattctcctttgacttcctctaagagctgtgaagacatgtcattcaaactgacagtatgttggaagaggagtagaagggagaaggcgggagagcggggtgacaaaaaaaagtggggaaaaaaggctcaggccagagaaaatgaattagagcaaatatgctttggaaacaactgccaggtcagatgggtgtgatcaaaggtttactgatgctgtgtggggaaaaaatcattaagaaaggccagaacaagacagtcgattccaaccagagccacaaataaaacacattcaaagcagtgccatggggtagcctttctgttacagccggtgaaataaaaacaagctgatgatagttggaaacaccaacaacagaacaaaaggagatactgatgtgaaggaaaacagtgcttcttacccagttcagttatcattagaatgtgcgtcccactgtttttttcctgattgactgataccaaaggcaacttgcccggtttagctaattggatacagcatttaagggttggggaaagggagtggaggaaagtacagaaaaagaagagagtgagggaataacagaggaaacattctcaagtaaagggaccccggaccacaggtagtttgcatttgtcttgggggaagaggccactctacagttttgcacactcactaatggtaacagggagtgccatggccaggttagaagttagattctattgtccaaccaacatggccctcaaaaccccatcattttgggggccagaatggcatttgctgaaaatggcttttggctgagatattcaactacgatacgttaaatgtcaagttattacacattagcccagggcttctaccttgttcccaaaatgggtttggcttagatccgaggctttgtatatcagtggaggactcagattgtaggagctgtccagacagaatgctcaaaagaggttcttacagtaaaaatcaccagaaagaatccgtgaactaagcctttcctcctttcctctccattcccaattgaatgccccaatcgcaaatccatcatctcatgctcctttgaaaacagtgaccagcatgaaggaaactgtctattcatctcagaagaaagatagatcagttttcccttccggtaatctgccatatttctccccataccttcctcccagccccctcaaaacaaaccccatagcagctacaaagttgaaagggctaagaaataaaccaacctcctcatatcctgtatggtttgaaagacagaacaaaaactccccccaaagctgacattgacccctacctagttcagtgatgatggggatgttgaccccagttgtgatggatggttgacgtaacatcccgtgcactgggctgttatctggagaggatctatccattcctggaggtgtgaaccctagtgggaaggaaacagaggaggaagaaaaatcagagaagtagaaaatttggaaataatcagagtacactatatacatacaaccccaaaaatgtagcttatgcattattcacaggtcaacaattagtattcccgggataaactctgatgattaattctttagaaggacagggtaggaaaccattataaataatcgtaactcacttcatagttccctaaaaaatccagacttcataccaattatttattctgctcatagatcttggctcccatctctttccagggacacaggagaattatcccctgtgcccccttgaagttaggtatggccatgtgacacatgaaatgctctggcccatgaaaagtgagcagagcagtgcatatcactgctggttcaggtattggacagccatctctctcttcccaggccatggcaactgtgagaatacaggttactatggagatgaaggctagacaacagccctggacagttacccagacccacaaagcatactgagtgagtcaagaataaagctgtgttgctttaagccgctgagatttgtttgtttgtttgtttgttgttgttgttaccacaacataacctaacctggcctgactgttaccgtaaaccaatcaattgcttatcctcttgctggtgagtgacttaggcctcagttttcacagagttctggccaatgggaggtgtcaggaaatcttcctggggctttcaggaagtgtttccttgctcttaaaaagaaacacataggaagagattctcttttaatttactgagcacggttttatgtgcctgtagtgccaggaactgaggcaccagctgagggcataactaacttagtgatattggctcaagtgaatgacaggaagagctgtcctggagttcctggggcaagcagcctggagccatcccacctcaggatttctccctatgtgagattttatacacataaacacacacacacacacacacacacacacatacacaaatgtatttatacatatacatacacacaatataataagatgttcacatttttttctttctgtttaagctaaatggagaaggagtttacttgcatctaaatcctcctgactaatgtatatgccacctgcttatggctgatcccttgaacttcccagtgtgccaaacacagaccacataaggtatatgtggacacaggaaaattggaaagcagcctgcttggtctctgattttgcagtttgggcttctttgggtcccaggtccaagccaagtacatacctggatgaggttggaacaactgtaactttcagtttagtgagagtgagaaatatcccggctaggcagaatgtctgcctcgttaaggttttgcatggacacatatcaatattagaaacctatttacttcctacattcatctggtaaaaattaatttttctaacgaagcatacggcagctccacgcaagtggcaagacccagtgcaattacatttagatgataggcaagcattcacactcacttcggtttctccttttttccttcagcggaatgctacatgggcttaccaatgaattagggacttttaggaacaaagtcacttgctaaatttccaaggataaaactccaaatagattattatgtgaccagatatctgactcactttccagcaatgtgacaagattgtgttgagtctggcattttggctaggtgtgagtcaggaatgaaatacgggagctcaataattgcctgttgttttggaggtgcataatgcataaaatgccagagaaatataaaagggttttcttactttctgctctcccgtgtatacatttcttatcactgagtgccatactttcaaaaagaaagacaaagttttacttaatatccattccctgactgcacttaaattgattctttacattaatacactatgaaaagggtaagtcattttgattgacattgtagtgtccatcttttcaaactttcgaatatatgtttttcagccaaccacataaccaaaaacacgcatttttaaatgctagctgttttcttcttctaggatggtgaaggggaaaactaaactgttttcattagaagtttcattcaaaaacatgaaaaactggaagtgacagctgtgcagattcagtggatgtgacgtttttgaatttcttcaacttgacaagtaaacaccttaaatcggtaatgctatatgcataatacatggcctgtattttgacatccatcatcaaatgctgacttgagaaaatacgggtttgtacgtcaaggaatagcacccataaagcagggagaaatgcaggtcacacggtattaggaaaactgtatttcattacagaactcgcaacaagccacggcatccttttattttatcttatttaaagattccattttcagctgtgaaaagactcaattcctttgcatgaaaccttcatttggaaatgacatgcttgcttcataggcttctttcattttgctttcatattccattttccccttcagtcaccaggcctggttccattagcatctgcaactgacaaactatggtaggtgtccaaagacatctctctgttgaaggcccaactctcccctatgcatgactccccaaaaaagtgtgcttttattgctaagaaaacttcatgcctctttttgtttccctacttttctagtcacacatttttaaaagcaaaaggcaacaataacagcaaagttggcttcttctttttccctggtgtagagttatgttaaaggtgaacataatttattagcattgtttctttcttaggggtactgatatgggaaaattatggtcagaaacggcaggattgccccagattccttaaatggctttggagagaagagaaattcaagcaccttccataaaggaatgaggcaatccggcctttgatgccataggatggtgtccaccgcattcctcatagctgcatttgataaaggggcaggtctaaattgtggcccaatctctgaccatcttgctctccttcccattattgcttgcagccatgactatatcatgggtagcacctgaagtctctctacattaaacaacgccctagttctgcatgtgaacacactggcacatggaatatactccagagatctacagctagagaacagtgaaactgggaaacactcccttcattagttaaactaacacttgggaagttaattttagaaacaaccacttattttgccagaaaagatgactaagaatatcaccattagagacatggaatgagaagtcctcaatcaggaaaagactgaagtttaaatcatccacagccaaagctatcaccagatgggctcctgattctttagccatgtacccatagcactttgttgatcatggccatgggaggcaagttttgtgctaaaaatgacttccatatgtttgttggccatttgtatataacatcactaagtatcaggaaaatgcaaatcaaaacacaatgtgataccaccttattcctgcaagaacggccataatcaaaatatcaagaaacagtagatgttggcatggatgcggtgaacagagaacacctctacactgctggcggcaatgtaaactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatatacacacacacatatatatatcacatcacacacacacacacacacacacacacacatatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactacaaatatggggcagtgtatactgcttgggtgaaggatgcaccaaaatctcacagatcaccactaaagaacttactcatgcaaccaaacaccacctgtaccccaataccccaataacttctggaaacaataaaaataaaataaataacttccaaagaccacctgaactccttacactgtaagttttctccccactccaatcttcagtggctggtgtggcaggtttttgttacctattttattcattcagcatgagacataagtgcttgaccaactttatcctatgacagatattctcattctatatactgtataagaactttaggtcagagactggattttcatttctttgaacttcccagattatctacaaaatgcccagcacatagaaaagaaatagaatgaaattgttaacagcatgggctgtaaagtcaggtgtcctggattcaaattctggcacctccacctataagccatggcactataagcattgtgcagactctctcctagtctgcttcttcatcgataaaccacaaatacctcccacataggacaattgtaaggataaaataaaataatgtatttaaaacatttagtacaatatctggtatgaggcaagtgctaaaaaatgctggctaccaatattaatattttattaggtatacaataagtattcgtggatcacttccccttccctatggataaagaactgaagaagtatttagtagattcttaaaaaagatttttcacacacagaaaatcctagaatactaatgagaaggcaatgagcattgtgtgtgtgtgtgtgtgtgtgtgtgtgtgtgtgtgtgtatatatatatatatatatatatatatatatacacacaatattccttatgtgatcataaggaaagaaggactatggctcagacaagatatacacaagtaatggctggaaaagggttccaggacactgtaaacccaagtgcattggaaaatgagaaaggctcaatggcattgtttttatgagactcaaagcaaaggcaagaatactctagacctaaactggttaataattgagaatgaagaagagagggggaaggctgaactagaacccaaagaaaaaaaatagccaacacttactgagtgcttactatgtactgaattttgctcacgtaataacttcggttctcagaaccatcctatgtatatactactatttttcagaggaggaaactgaagcacagagaaggtaagcaacttgccccaggacatacatctaggaattagcagatctcagagtggaacccagataaacaagtcccagtgtctcctctaagccaccacgccatattgcttcttatgtgccaggctgggctaagggttttttcatgggccaccttgtttattcctcataacagtccctgtgtgtttagggactgttgatatttgcattttgtagaagaggaaaataagattcagagcagtggcataactggctcaagcatacccaattggtaagtgtccctgggagccgcagccaggcagtctgacctcagactcctgacacctgcaggctgtgccgcatccctgacttgggtgctggccttctccttctaggtactgtccctggcaggcaagtctgaggcctgagccagtcttactttttattgttttcacttttaaacaatagcagataacaactgggacccattgtagttatgcttaacttgctttggtatggcagcatgcacaactcagtacatataataaatgctttattacagtacttttccatgggggaaacacaaagtactttctaaatcttccctagttaaatccctgagcctttccagggagagagggagatggaaattcttatcaatcatctcccctagaatagatggagaaatgaaggtaagtgcttctcccaccccgatagacttaacataaaggaattggttcaaatggtgggccaaattatcttttattgtgtgcatataaatgatggttagaaatccatatgctacgttaaactagggaaataaattaggccgagtcatctaggtttgctgagacaggtattcaatatgaagttgtaaaagggaaagatcacctttaaaaatgatctataaagacatgttaaaatcaagagaaacatctcatattacatcatctatgagatgaattaaatttcctgttaatgccagggaaaaaaacctcaaaggcaaatgtcagatgaagtgcagatcaataaaaatattttgataagtaaatgcaacaatgctatttaacacatgattggcaactgctgaaacataaattatccaaatttcccattgctgcttatgggaaaattatgcagattagaacttgattaggcttatatcatgagactcaatttggacttttaatctattaagctccaataaatgaggcatctgaatagctcccctgagcaactacggtaatagccacagcagtcatttttgcagtatgtattccaacgaatgcttcagcagctgaagtaaagaaaattccatgtatagaagcacaattgctttctaacttgtaggggaagaaaatccacacacaccaggttgatttgggaaacaggtttttggaaatgactgcaagaaaaatccagccaaaggaaaaacctcagtttaaccttgtaatattttttcacagtagttttcagtggcttcctatgaagctagaatccagagtcaggaaggccaggcagctgaccatgtttactcaataaaaaaaagattatttaccaaggcagcagcttctcctgaaactccccaaaggccaccccaacagggtagaggtagcccccaacaaggtgctggaggtcagtgtcaaggagggaagcggggaaatgcccctgccaatttgtgactcccccgcacaaagcctaatgacagtgcttggaaactgtataaacagataattctgtgactcctgagccaaaccataaggtgtcttttgcctcttcagcaatcattctatgctagaaacacgagagttttcaaaatcctctaatcaattcctccattcttcaaatgaagaaactgaggcttagaatggagaagttattatatccaaggtcacagaaccagttagcagcagaaccaggatagttgatatctgctgttttctgttcctttttaactccttctatgcataagaaacccattccacagtgtttgttgggggtgcagggaagaaactccgcccccaccctggaaacagaagtggcaacatgaagccaggcatcctgacttcacagggccgctgatggtcctgcataatcctggccacatcatcagtttagagatgagtctgtcctcctcaatctagggcctgtccgtattctccccaggacattatgtaaaagatggtaaaggttctgtggttgcaaagtcaggagtctgcaggtgtggggctactggcaagcagttagcccaccatggggtgaatgaaaacagggcaaatgaaccaagaggtggagagaatgagatagagctctgtcattgttcaagttcctgcacacaaatgtgcctaaaaccagagacattccagttatatgtctctgtttttacttaagcctttttgcattggatttcacttgtgccaaaatgtcccaactagtacaacaactgagaaaaatctccattctcttcgcggtgaaatgattcatgctggcctgattttctactgaaacaaatgactgcatcttcatttaaggtttcctgcttgtctccagtgaccagggacaagacctggcttaatactctccttgtttctttctatttacagtaactaacagtgacatttttagcggtacatttttttagagactgtctttgattagcacctttgcaagttgactccacccactgaataaagtgccccatcctttttagagtttacattttgggtccaacccaaaccaaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctattcgggaggctgaggcaggaaaatggcctgaacccgggaggcagagcttgcagtgagctgagattgcaccactgcactccagcctgggcaacaaagcgagactccgtctcaaaaaaaaaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagctcatggtatcattgctttctccacaacatctcaacttctcagttttaccttatcttaattcatcttacaatttaaagataaggccagatgcagtggctcatgcctgtaatcccagtactttggaggccaatgtgagtggattgcttgagctcaggagttcaagacaagcctgagcaacatggtgaaacctcgtctctactaaaaacaaacaaacaaacaaacaaacacaaaaaaattagctgggcatggtagggtgtgcctgtattcccagctacttgggaggctgacgtgggaggattgcttgagccagggaggcagaggttgcagtgagccaagattgtgccattgtactccagcctgggtgaaaaggtgagaccctgtctcaaaaaataaaatataatgagacatacttgcttggccagtgtggatcaaattacttataattttacctccactttggcctaagcaattgtacttctaaaaatatgtgtacagccataatttccttacattaaaaatttggctgccagggtcttcattcataggtattaagtaacaacattccactgaaaacaacatgaatgtccaattttagggaaattggttaagtatgcatccactaaaaataatgcagaaaaacatttcacgacagaaaaatggtcatgataaaatgtttgtgaaaaaccacaggtaacatactgacatgtatgatccatttttttgagggtaaaagtatttatatctatggaaataagacaaatatgtcaactttcttatgtctgagcagtaaaattacagggaatgtgcattttctttttggtttctataattgctaaattttctaaaataaacacattttatttatgtaatgaaaaaaattttttaaattataaattgatgttaaagaccctgaaatctcgaaacctcatgtgatctctatgggttgagagcagctgatgaacatgatggatggacacagctggttcatctgtaagggtctgacaggtctttgaacatccacttgatttggcagttaaggagactgaagttctgagatggaagtgatcaggccaaggttacaaagcaaaggggctttaaaagaacagggcccagagagagttttcaggcttcctagttctctgttatttcagcctcccaccatcttgtaagagctactcaatctcagagcagaggccatttacataaagcacacatgggcagtgaagagcccaagaaacccacaatgccccatgcacataggggaagggaggagcagtcagagctggtttccaacacagagggaaagtggcacctgctgatgcccatccctgctcccaccagccttacccacttcagaaacgctgttccccctcttccctcccaacccagctcctgtcgtttctttacctcttccaggacgtctgccttgaataacttctcacatttagttactttatgaagatgttttcctctgcctttttttccatcccctttattcgttattttaaaatgtatgaattattactaaatatatacaaattactacatattaatgtttaaatgttgttaagcatctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggatactaataaaacacacagacatcccccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaataccaaatgccaaatgggccccagttgtttggtttagtatgaattgatggccagcacagcagaaaccagaactccaaaatcacgagcaaagtataacatccatatcttaagcacacagaaaattaagtagctgtaaaagatgggtttgccaagtgatccaaggccttgccatgaaattcaggaaagcagaatcgcatcaacaactttcagccagctatctctgaatggttctagagacaagacgcctggcccaagatagcaccaaggttccaaacagttgatggttctttaaaagaaagaatctttttttcttaagtgttgaagtgtttcctgtacatacgtttatgctggcagatgaataggaaactgggatcttggatcttggggtcaggcattcccacatacatacacacacgaatcttcactagatgagggtttgatgctggtttgactctgagcatctctctgtacagcgtggtcaataacttttgaccactacctgaaataagccataccatttgtggtctagaacttgaacactgtggctagactgaatgagtttgggtcctgcctctttctgtttctaatttgtgatctggggcaatttatttaaattttgtgtctcagtttcctcatctgcaaattggaagaggaagatgtcatgaagattgaatgagttaataataataatacagggaaactgcttacaacagcacctggcacagagcatgtacttcatcagtactaacttactattatttatcaacaacagggttgtaagctgacagagaaaacaaaacacatgggttttagtcccaggtcaactcctacctctctgtgagaatgtagaaggattcaatgtcttatccaaactcagttctcccatccataaaatgaggttgtagcaatgtcccaaatccctttagattaccgtgcatcatacataatattgaaaccacgataattctgtgttcagctactcaatattcaggaatgtctgtggagtcattcatggggttgttcttttaaggaagtggaacacaggagccctctcttccagaatcctatcacattgtcggtatcaacaaacatatcaacatttcatacaagagatgcgcaccaaatacattaaaccacaacaaccatgtagcttgcacatcacaactccaggtacacatcatatcctctctcaggagtagcccctaaggcatgatcctccctccaggagccctgcatcctttccatttgctaacagtcaaatcattcatttgctgctatgcgatcacagtcgtggcaatggctgtggcccttggtgtcttcatctgtaaaataggaatgactctaaggccctctcagctttgagatttatgtctctttcatgaccccaaattttaaacgtgatctccaacaaaataagctagcaaagggaatccagaggatctccttacagactccttcacaagctctagtgtacatccagatttttttgattcagttttatacctttgcccagaggataaaacttcacttctcaaaccaaggagaaggaagtactttctccaaagttgctctaatggctgagaaggccataaataaccatttattaaacaaacactatgggctaaaggaagagaaaccaccgcaattaggcccctgaggcctgcaggcacagtacataacgatgggactctcataatccaggcaatatataaccagttgttccattttcttgaagttatcttcataatcaagatgctatctcgggcattgtgggctttaaaactatttttaattttaatttaaagagtaattaaagaaagacaatggatatgcaggataataaagtaagcgattagcagcatgcaaatgacataggcttaatgataatatggttctagtctccaaacagcttgtcgagagaaagccctttctacatgtggttgttcagctaatgtgtctcaacccacaattacaacattgctgacaccattaaccagtgaaacaacaccacttcgcgaaatccttgttgtctcattaaaaaggaaagggtcaggtaatttaccaacgttgtatgtctagttttgttgttggtaattagcaaacattacccagcatagactcccactgggaactggaggaactttgtgaaatattaaagaagaaagcctttatatttcactggaaaattgaaaagaggtgcagtaatattctccctgtcatctttttgcatttaggaaaaggaaaatgcaacttggaactctttaatttcaggagaaatattcaaaatgcattgggaagtcactacccacattaagaccctggatcaccattgtatactggcaaatagaatctgcatccctgtttacaaaagggagttggagatgggaggacgggaaaattgcaaactttatctttattgctcttacttatgttatttgaattaatctccttgaaacagaagaaaggagatataaaattttctttttgaaatgctacgggacttaaataagcaccagaattatttattcagaaaaatacacacacacacacacacacacgaacacgcgcgcgcacacacacacacacacacacgcacatacacacacatatttagacctaaagagagaagaaatatattccagggaagagacttcctgcctccatgcttcctaatagaatcttccccacattggaactcagaccccgcccccaacactggccaatgcttggtgtgttgtcagggagtagaatggtatcttattctttaaatggaacttttggaacataaaacacattccaataaatgtgagcagaaaattatgaattcattaaactactttggtatcttgtgctatatataatatttatattccgactactgtaaaatatgctttaatatctttaggcaactataaggacttaaatatttataaaatggctaaagataaagtatggccctcttattcctacatacagatgatgtaaggcatgcaatcaaagacaataacactctctgcccatttgtcatcttaaaggagccgatcaacgcgccatccctcgtgtgccatctacataagagttgttgccgacacaggcaactccagaggagtttgcgccttaaaaactacctagagtgctatacttcatagaaaacagggctttctgaaaatggagacaaaacaataaatttgcaggcaaaacagctccaagaggggcttcaaagtactgctgtatttatctctgggacatgagggaacaggaagcattttgatttaatatttcataagatagagacaattgcttccttgcatggtatatacttaatgctcacagaaatgagttttttttaaaaaagtttcaatatcttaaatgcaaataaataaataaataaggagacacacctgcataataggaagggcttcctttggaaatatggaatagacccatataatcccaataaagagaaagccaccacgaatttataatcacctaggggcctgttaaaagtagttttatagattaagtgtgaaacctcaaccctgatgttattattatttaccttccttgcttgcctttaggcccatggcctgattgattttcaaaattcttccatttcctatgctgattaggtattcaaagaattgtttgtgcccacctgccttgacctctcaaatggacaccccctggtttattttcccagctcccactagctccctgctgggaaccatgtggaagtttgtgaatttctcatgtatcttgcattttcacaatgcccattatatgctttccaaatctcctagcaatcatgcctaggagaatgatttattctataaataaatttccaagataaatttctatggaaatgtaagctttagtaaatcagctgcctgatacaaggatcagagatggtttccttgagtaagtaaggggctaggctggtgtttctcaacttgggctgcacgttggaatcaccaatgcatgcctgcatcaatgtctaatttaattgctctggagtatggcctgagcatttcaagaatgttaaaagttccccaggtgagtgcaatgtgcagctaaggttgaaaaacagtgggctagttcagaattaaatccacccatttaagggcaactaatctttgacaaggatgtcaagaacacacaataggtaaaggacagtctattcaatgaataatgatgttcagaaaacaatatttacatgcaaaagaataaatctgaacacttctcttacagcatatacaaaaatcaaatggattaaagacttgaatgtaaaatctgaaaccgtaaaactcctaggagaaaaaataggggaaaagctctttgacattggtctgggcgatgatttcttggatatgacaccaaaagcacaggcaacaaaagcaaaaattaaaaagcgggactacatcaaactaaaaatctgcacagcaaagaaaacaatcaacaaagtgagaagccaatctactgaacgggagaaaatattttaaaaccacctagccaataaagggttaatatcccatctatataaagaactcatatactcagtagcaagaaaataaataacctgattaagaaatgggcaaaggaacctaatagacatctttataaagaagatatacaaatggccaacaagtagatatgaaaaggtgctcaatatcactaatcatcagaaaaatgcaaatcacaataagatatcacctcatacctgttaagattgctattattgaaaagacaagtgataacaagtgttggtgaggttggagagaaaagtgaacccttgtacactgctggtgggaatgtaaattggtacagccctatagaagacagtatgaagtttctataaaaaattaaaaatagaaccaccacatgatttagcaatcccacttctgggtatatatccaacagaaatgaaatcagtatctcaaagagacatctgcacctccatgtttattggagcactattcacaatagccaagatatagaaaccactggtgtccattgacagatgagtagataaagaaaatatggtctgtgttgtgtatgtacctgcacatatatataatggaatattattcagccataaaaaagaaagaaattctgtcattcaacaacatagatgaactggagaacatcatgctaagtgaaataagccagttatagaaggacaaatactgtatgatctcacttatacatggaatctaaaaagttgaactcatagaagcagaaagtagaacagtggtggccagggactgtggtgagggtcagggggaatggggagatgttggtcaaaggatacaaacttgccattataggatgaataaattctggggctgtaatgtaaagtgtggtgactatagttgatagtgctgtgtagtacacttgaagtttgcaaaaagaatagatcttaagtgtcctcatgacacacacccgggcacacacacacacaatagtaactatgggagatgatggatgtgtttattaacttgattttggtaataatttcacaatgtatatgtatatcaaatcatcatgttgtaaaccttgaatatatacaacttttacttgtcagttgtatttcaataaacctggaggggaagaaaatcattagggtagacaaaactcttaaatttgtatataaatatttatgtgtctatgaagaggtaggaggagggtcacagagaagattcattattagctatttaaaggggtaggtacaagacccctttcccagttgagaactaatatgctataggttttctggctgagacccaaaattactgttttaagaaaaaaaaaaaaaagaggcaaaggagggaggccaagtgccatctgttgactaggtggagtagcatgggtcctgctctggaagggtgtcacttcaccaacatcagggctcctaccacaaccaaaccccagaggttggaagtgtatgaggttttctgtcagcgagctgtcccaatctctgcttcagagagcagctgcgttgcatggcgccatgctagcctgtctatggaggggaagcgccccatgctcactgttcatctgccctagtccttcctcaactcctctgtaggcttttgttagtctaccttacctggtctgctcaccttccaaaggtgtgttggtttctatcatcatctattttctatgcatatttacagacaaacagatcaacagtaattctggctgctaggtacaagtggataatcctaacttatgatttgttaatctgggagtaggaggggatgaaataaaatagtaaaattgtaataataataacaaaaatagctaacattgcttgatttctcccatcctaggtaggaagtgctttaacagccattcattcagggttgccatgtatggttgtgaaggttgggcactacacagtagctaatctaagtgggtaccactcatatcaataggcattgtatatttgcatatttatgacaatattttttcccagcagatgacagaaaagtgtattgttcaaacatattagtagattatcaccatttttttcagcagatgaaaataaggtgtcttgagaaaagagtgactttttctggcttacttaaaggtactgtatggacaatagaaagtcctgtatctcattgaattctcatagtcatttgataagccaggtgcatttagtattcttagtgagaaaattgagataaaaagaggtaaagtaattttcccaggcctagtaagtggcagatctgggcttcaaacccaagctgtcattccagacccatgtgtgccatgactgaacttgactgcaaagtgctatttctacagcctttgatgtttaataacctttctgcagccattatgtctttgtattcatacactgatccctcggtgttttggggtggggtcatttaatatatagatatatagatgaggaaatgaaatctggaatctttattatgtcaaattgctcatgatggacagaaccaggatttaaaagctgttccttaaccctccatgactgcatcattactctgacagccatgtttgtgattcactatcatgaactagagcaacaaaacacatcttccaagttcctcctgctccagtctaccgctgagaggaatgttcatttctacatggccagggaagctctcaggaagcattcacagctccctggagcagaaagcagagatattttctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaacccttgtccagtgcccagttgtcaaatgaagggagactaaatcctggagggaaagtgtaggtttttaatacaggtatttggctgctttatctcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatctactcaggttaacagtgcacccacctacaagcatttcctttgacatagtgagccctttaagtaccttggttataccattagtacacaaatagccaggtgaccctctgtgaaaaacactcggcctttcctgtttctgtgccttctgttactcagcttcagccctttccacatgcctgtcggaacctttatttatattaatcacacttattttcaaattctggtccctttactctggagtctttcctgactaccacagcccaaagccacctctgccttctcataacacattgtgtggcagcatgcatgggacactgaaaacatctggtagaacatctctcctggagatctgtaacaagatgctcaaggactatcctgcttttctggaattcagaaaataattttcctccagaccattccatgaagtataattgaagcatttaaggactagccatatccttaaatgttcaataaatccagaactaaagtcatttataaatcagttggcttctttgcagtgccactttttctttctttctttctttctttttctttttgcttgtttgtttttggttttgtttttgagatgggatctcactctgttacccaggctggagggcaatggcgcaatctcggctcactgcaacctccacctcctgggttcatgtgattctcctgcctcagcttctggagtagctgggtctacagatgtgagccaccacaccaggcttatttttgtactttaatagagatggggtttcaccatgttagccaggctggtctcaaactcccaacctcaggtgatccacctgcttcggccccccagtgtgctgggattacaggcatgagccactgcatctggcctcagggccatttatttctttatttttttcttgagatggaatttcgctcttgttgcttttaagaaaagaagtaaagtttttaagactgcacatgagctattgcctatagagaataggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggataaggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaaaatgttatttaagtgtcttcacaaagaaagtaacagctaggtctcaaatattccactctcttccttacagctccgaagtcccatctatattcacaagaaaaacagaaaagaaagactccaacagtcatactgttcacagagacaggctaagcacagtgcttcacattgcccccagatttactcatttgtccagtggtagtagcaagaaagactgaagccaacagaatcctagtatctctcattgttggaacagctagggtcaaggggctcaaaaaatggggattcacagagacaagaaccgttgaaaacaaacttcagccccttaggtgcaaggaccagtttagaagtgaggctggcacaccttgagcactttcatccccttgagtgtttgtcctgggggtgcccccatgacccttgaaagtacatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctactccagtgtggtatttataaatctctaaacagttaagtataattgtctttctggtttttgggacggaagccaacagcagtttcagttacaatggaagaaaaatattttagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtggaagttgaagatggggtggtctgtccaattaatggaaaagccagatctgcagctgctcaccccaatgccgtccgctccccatctttgaacacaaagacagtgccgttcaggaaggacatgaatgcttccactaaaagactcatgaccccaatcctgacaaacaccatagctctccctctggagttacaatgcaaatcatataaaacacagatccctatgtaataaaaatcaagaacatgctggatatccttagttataaaggaccacagaactcatctctctaccaatctccctcccatcacaaagagcgtgtcagtaactctcctttagcaaagagacagtcagggataggaggctcgctgcatttgcaggctgtccatgctgttctggaaatatcttccttatgttgggctaaaatcctgttctccttaattattaaccattggccctggtttttgtccaatggagcagaagattaaatggccctttaagcctgctggctttgttctcttaaccacttggcaagtgacatgttgtccaggcactgccccattctggccgtcctctttacaacatttttctgtttgtttgtcaaatttctgcttcaaatcttcacagctcttgacacattccctcctatcccaacaaagatgaaacagtcactgctcaaaagaaatgatgcttttatcaccaaggtttatctagcctgtctttactgatcatttgaaaattaacatgcagaggtcctcaatgcattctgtcctgtggatttcatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattccctacttgaggctcttaacctttgttgaaatgtggagaaaggagggtgtccgcttatatgtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaacttttcctggattaaggacttcatttccacccttcagcttttcatgcccatctggattttccactaagtccccgtggaaataaaccatgactaaaacccaatcctcccaacactgctttctcctgcagcctgtccctccactctgccatcctctgacccccagaaggaaacacacatccatgcagactgttttgcatgtacagtgactccttctagaacctcccattctttttccagtccaaggtttcaggcttccatctggatagccacagttcctaaccagagtccttgcatcttcttcctttccactccaaacaatgcttcacagggctgccagatccatctccctaaagctcaggtccaatcccatcactctcttgctttgaaaccttctgtagctccccagtgcctagtgaattatttacagcttcctaactcataaacacataaaaaattatttacagcttcctaactcaagaaagaaaagaaattcctcaatgcccaacccacatttcaacttcatctctccctgctgccttatatgtaccctgtattggggccaaattgtacttgtccctgtccctctaacacatccccaggaatctttgccgtcacttccattcgctccgtctcaagccagctcactttgcctccacctgttatctttttcaagcatggaattaattactcttttcctataaatctttgatgactcccccaaatccaaacccttagcaagacaagtctacactctaggactgcaccatccaatatggtagccactggctatggatcactttaaatttttatatttgttaaaattaaattaaaaggaaaaatttaattcctaaatttcaagtgctccatagccacatgcattcaagtcatccacagatgccacctcttcttttttttttttttttttttttttttttgagatggagtcttgctctgtcgcccaggctggagtgcagtggcatgattttggctcaatgcaagctccgcctcctgggttcaaatgattctcctgccttagcctcccaagtagctgggactacaggggcgtgccaccaggccttgctaattttttgtatttttagtacagacggggtttcactgtgttagccaggatggtctcgatctcctgaccttgtgatccacctgccttggcctcccagagtgctgggattacaggcgtaagccaccgtgcctggccgatgccacctcttcttgaaagccttctcaattcctcaaaatacctaaaccaaggatccctttgtgttcctctatttctagcctcgtccttgtttccttggactgtcattgtttatggggatacctcctccactcacctgaatcctgcaagcatagtgagtggctgaatccaagcaacctttggtcacctttgtgttctgggcctttagagtgcctgatgcatggagaacagccatttattcctttttcttttccttaggagttacctttcatggaagggtaagcaggaagcaactacaagatcatcatttcaaaacaatatgaaagcagaatgggaaatgccatggcatgctccctcttttcaggtatgaactgaagcagctcagagagcggacattgcctccctctgctcaccctttcttccaagatcagactcagttctcatctttttgaaccacagggaaacagtctggcaagagccactgttgtaccagctgatttaaattgaaatgttttccccagataaatgcgtgctaaataatacaccagctctccagccaaagggaagtgacaggcactctgtaaataaaggcacttagttgctggtaaagagctgtaaagtggttctgagctgatgtttgctgaccagcaagaagcagcttcatctgctttatataattgtcactgcagttttgcctgctgtatattaaaactgcatctcatagacccaactgtcacatcggatataccatctggcttgggatatgccaccttttctgtaattgtttttgacaacaagccatcacatcttgggtcttttcagaaagtgtctggtccagaatccctaggctgggtcagttctgacaccatgtgggctagaaaagtgacatcaaaagggagtgtgaaaagagaacagaagagaaaaaagaggctttgttagtctaggagccctaataacatgcagtggcagctgtccaatgaaggctctactttctcaatgtgaatgcacatttttcatgctaaattatatcatcttaggacagctttccatagggttgcatgcatattctggcccaagagcatgacatttgtcctgagtccacatttctacccagtgaggttctagagacatggagacagttcttcagacaatgcagagcatgaggttccataaaggaccatagaatacataagagggaaagcaaggtgtcagtggccagaaatctgtgtagttatcactcagaggaagttagatttgttttccaaaatgataagagtaacatgaaatccccagcactttgggaggccaaggtgagtggatcacctgaggccaggagtttgagaccagcctggccaacatagtgaaactctgtctctactaaaaatacaaaaattagccgggtgtggcagcacgcacctgtaatcccagctacttgggaggctgaggcaggagaatcacttgaacccaggaggtggaggttgcagtgagctgatatcacaccattgcattccagcctgggcaacagagagagactctacctcgaaagaaagaaagaaagaaagagagaaagagagaaagaaaggaaggaaggaaggaaggaagaaagaaagaaagaaagaaagaaagaaagaaagagaaagaaagaaagaaaaagaaagaaagaaagagaaagaaagaaagaagggagggagggagggagggaagggaagggaagggaagggaagggaagggaagggagggaagggaaggaaggaaggaaggaagggagggagggagggaaggagggaaagaaaagaaaagaaaaaaaatggagagtaacatgaaatcctttttgttccccataatccctattcccttggagcttgatcatgccaaatgcccagatgaaggatgacaaaagtatctcaggccagtgggcactccagttagtcaaaagggtctcagatatagaaaagcagggaaactcagctcacagagtcagctcacaggctgggaggagcccaaggagtggagtgctgggtctgcagccagaggtgagctctggggaaggagcgatttctctgtgttgatggctcccactggaccactgcctttacaaggttagagtatcaccagagaacagtattcaaaaacaagagaggagcagacagacagacaagaaaacaatgggacataaagtcttggtgggcctagagctttgacactctctcttagggagcagaacagactgctggctagtgagagacagatgctcctctccactgctgaccaggggtctacgagaatcactgctgagcatagaaacacatcctttgccttcttctgtcatttgtgcggtcttagtccatttgggctcctgtaacaaacaccataatctgggtggctgatagacaacagatatttatttcccacagttctggagaacggaaagttcaaggtcaaggcgctggcatgttcagtctctggtgaggactttctcgcagtgtcctcacatgacagaagggacgaggggtctctctcaggcttcttttactttatttatttgtttgttggtttattttattttgttttagacagagtcttgctctgtcacccaggctggaatgcaatggtgccatctcggctcactgtaacctccacctcccgggttcaagtgattctcctgcctcagcctcccgagtagctgggattataggcacccgccaccatgcctggctaacttttttgtatttttagtagagattgggtttcgccatgttggccaagtggtctcaaactcctgacctcaggtgatccacccgccttagcctcccaaggcgtgagccaccatgcctggcctcaggcttcttttataaggacaccagtcccattcatgagggctccaccctcatgacctaaacacctctcaaaggccccaccacctaataccatcgccttgagggttaggatttcaatgtatgtatttggcagggagtaggtggagggtacaaaaacattcagaccataactgtgtgcatgtgtgtatacaaaagaaagagtgccctttttttctttggaggaaaaataagctccctttctctttcctccatatctcctgtcaaaacctatttttcttgcttatcctgtgctataaaagaataaagaaggcttttgggcaccggggagtggaagaattgttaccagtttggcctttatataggatctaagaggctgggatgaggtttaagagaactggaaggaacaactatatcagatgtgtatgtaactaaattatacactgacattctaatctgtggccctggaaaatcatgatcgagtttggaggaaacaggcatgttggggaaagggagtgttttcctgcctcctcctgctggcttctgtctgtacttaaagggagaatcattgctttcactgttttcctttccccttgatggttcactcctccccaggagaggaggagcatctaccaagggttggtcacatcctgttcatgtgaaggtttactgtgctttaaaagggcacatttgagttgcctggggatcttgttggaatgcagattctgacccagcaggtctgggatggcccatgaggttctgtaactctaacagcctcccccaacagacacccatactggggcagggcagagaggacacatattgaaagtcaagggcttaaaggcaggaaccaaatgccggcttgcctctttcaactcctagaaggtcagcttactgtcttctcacatcctttctcgcctgtgctacccgggcaggccgcacaggatgcgggctctacctcttcaggatgcagctgggagtaagctcagagcctctcctaggccttcacatgttgtgctgtcctgcgggcacagctgagcaggtggataccaagatttagatttgggtgtggcagggaggacggtggcatggagaggtcaaaattaggcttcaggctgtatcagggtgatgtcagaaggacagaagccatttcacatgcaccaccaaaggggaaggttctcttaagcttgaccagaagctgctgtgaatctcaagatcctcagagaagccccagcccctctctcagtctgtagcagtgaagacactggctcccagaaagctcatctgatagaagatttgaacctgggtctgccagggtctggctgcagttgcctccaaagaatcaaagcctatctttctcctccactttccaaatctcaccccagtgcccatctcccaccagctgactctagcccagagccatgcagggaagaggattccaggaactattgttcctggcttttctgcaatgctaagcaaatgttagaaggcagtggtggtgatgtcaagttgacaaaaaataatgtagctcacaggtccaggatgcatgattcagctgagcttctagaaagcctggcatgatggggaggaggtcagacacttgccaagctatcaataaggtgatgcttcatatcccagtagccatagctctcatgggctgtgctcctacacccttccatcctggactgatgggattctggtccccatcaggcagccaatgccaccctctggcagctcgtctgtaacaactatcctccaattcatggctagcctacacggaggtgtcactcaatggaaaatgctttgcatcctatcctgccagatcctgattacagaggtcattttttatgaaggttttgctgtgttgcctttctgagacccctagacatctttacttgtaaccacctgcccagggtcccaaagcaaatgacaggaaagactaggggcagagtaggaaggcagacgtgtgtcacttaaggctgctttgcctcctataggaaaatgtgtggtctgacaagtgtcaccatttgctaaatgacttttagtgtccatagagttgccactctccagagattaccatcccttggtcagcagagtcctagaggcggctctaacaatagcaaagcttcattcccatcccagctcaatggcaaaaacatatactggaaggaaacggtcagaattgtgcagccagcttcttttcagtgctctgacatttagctgatgacactggtcatgaagccactccttgggaaagctgagggggtggctatttaaaggcttgtttatcctctggaaaggcaacctagtctgtgtgtgggtgaccaggtctcaagcctgcattctggaatggaaagaagaggcagcagatgcccctttgaaagccatcatggtgaccgcaggtttcactgccaggcaggctgatgtgagcctctttgaattactgagtgaaggatatccctcttgccagcccctgtcccctgcaggcacagcaaagaagtattacaggctgtccttaccttgggaattagcctgcaagactccgatgctgtcatcaaactgcatagatttgatgttgagtgacgccaagatgcattccttgtcctgcagcgaagtatcatcaatattattctgattggctgacaggataacgcacatgtcacagaggttgatgttgacagcccttaaatcagcccgacttaatggcgtaccctttggcatagaggaaagaaaaaaaaacagagatggggggagaaagagacagagagagagagagaggagcaaaagtgagaggagagggaaagaggaaaacaaattaaagattgagtcggagctttgggaaattatttaacaagtatcttttttatgccttgacattaagctggcctaactacattcaagggaataggagctgtgtgctaatctaaagggtagtcggtgctgatggcagcattttaagcttgttctcaatactcaatcaagctattactaacaaacgcgggagaggaataatgccagggttctacatcttcttcctgcctggaaattgtcttgatttaagtaactgtcctgtggcaacctctggctttcagaatgtaacaagggggtgggtttcaaatgcctgtttatttaatagcgggtcacttctgtctcaggcaaaagacagcagttccaatgcagccaaggagaaatggccagtgagcacagagtgatgaggtgggcctggatgtgcggctcaatttggaggctatggatggagtggaattaatgtgtgcaatgcaaaagagatatggaaaggagttaagcttcagatcatataattttattgcatattttcagcaagaaaaaaatacacagggaaatgacctaattgtccaacaacataggaatggagaaatatacttttggacatgcacacagtgaaaatgtatgcaggaggtaaagaggcagagctggctctccatgcaggcattggtttagaagcctaagatagagggggaagtgaaaaaaaaagttctacagcagttaaaaaaaagtatagtttcatttatgtaaaaaaaaaaacccacaaaataaaattacatatatataaatgtatgtaaatttggaaggaaagcacaggaaaaatagccattacactaataatggtaattccctctgggaagggaaataggattcgtgggggtgaggggaaagtttgcttttcactttatatacttctatattgcttgaatattttataacaagaacatatttgtatattacaggtacatttaaaaaataaataagccagtaaacagattttttaacataaaaaataacaacaaaagacagtggaaaaatcccagatccaggaagtaacaacagagtccgggaatgcaagcatagggaaaatagaagggttaggttaggacagggccatggcctccacatgctctgtgtcttcaggtgaagccacagcaaaatcatcaggccaccccatgccatagctccccagtggccacgcggcatcattttggggctcctgtctggccaccagcttcattggtcctctagcttgaatctagcttcctctttgcctgtgtggtgacctgagttaccttcaactcactgattgtgtagaccaagggtttgccaactgtcacatatctgggaatgtcctcctctaatctccctttctggagaactggctttggaaagagacttggctgcagagatggagcctatctaccctcttttatgagtcactggtagtcatgattctattctcaggccctaaaatattgtgcaactatggaggaaggggcatttagcactgtggttgctgctgagacacaactagttccaagctctggagcagcgtctttttgagagaaggagaatgccctcttctcctgtgatctcttggtacaaaacaagtccaaccaacttcctgaatcattttgccagtgcataagcttcaattgcctgcatccatattcttttaattttcatcttgtagggaagccagccgtaattgtgatataagatgatccctgtgcagttgtacacacgtgatttcaaactacaagaaatacaaatgacatacatagaaatcgcttatgtttctctgggctggccctataggcagggtactgtttaaccaataaactctgtgaagacataggtgaaggcccattttgtgaaaatctattgtgcttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcgcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatgacagaaagataaccatggaatcatataatcaaatcgaccatatttctggaatgagcaaagcatatatatgcttatgctctcctctgtgtatgactgtttgtctataggtgactattttcaactgcctgtgctcactaaggcagtgggtttttggcccagcatccaaaagataactgtccgatctttttctcactcctttaaatatttattgagtccctattgtgtcaggcattatgtaaaggcacatggtggcatctaatgagtaacatgtactgcttgtggatagattcttgtgtgttctttaatgaattatattacttggctctttttccccccatttctgaggttttggaagctgataacagaaataatacattttagctttgtaagtgggggaaaacccagacttcttaacatgtagagaaatccatgttcctcagttgtttcttgttttgtttttgtttttgtttgaggcaggctcttgttctgttgcccaggctggagtgcagtggtgctttcacagcccactgcagcctccacctctcaggctcaagtgatcctcccaactcagcctctcaagtagctggaactacaagcacacgccaccacatcaggctaatttttttaactttttgtagagaagaggtctcaccatgttgcccaggctgctcatgaactcctgagcttaagtggtcctcccgcctcagcatcccaaaatgcagggattacagggattagccactgcacctggcccctgtttctcagtttcagggatgtgaacttacaagaaaaatatttggaggataagtgagatttgcatgaatttgtgatgtggagaattacatcaaatgttgaaatgcataattctctacaatgttttgagagtttgtggactatgcattcattatgattaggaagtagttaattacatgactcctaaatcccatatcctcacactaaattgtggagtcccagactgttttttcagactgaagtcctaatgttttgcagtcaagaatatcatgcacacatgcacacacggacacacacacaaacacaaccatgaacacgttgctggacttctaaatgaacaggggttggggctgagctgcagaaggagttggccttctgtacagcagaaataaagaactctgttatttgcatttatttagttaaaaacagaaggtggcacagatcaatgtttcttcaagcattaaaaatgccataagtataatgctataaatagttctgtaagcaaatccttactataaacatcataatataacaatgctctaggttttgtataggcaggagtgagagtgtttagacgctgatatggttaatatacttgatacaagctaaacttcatccctgatgagggactgaacttggctgcaaattccttttaataaggtctcccagggtttggattttccttgacagagcataggggaagtgctgagtcctcaggcccatacccagatgaagaagcacaggcatgatcaaagctacaactattatatccatccgggattttcttttgtgaatgaaaagaagaaaaggcatcaataatgtgaccttggacttacaggcaatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcacgtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttagaattctagacttatcagtgagatgtccgtgcatcagcaggtggaacatgctacctaaagccaggagtggaaaactacgacccacaggccaaatctggcccactacattcttttgtatgttcagtgagctaaaaattgtttttgtgcttcaaaatggttgaaaaaaaatcaaaagaagacaatgtcataatctgtgaaaattacataaagttcaaattcccataaagttgtattggaatgcagccatgctcatacgtttaggtattgcctatgggtgcttttatgctacaacagcagagctaatcagtagcaacagagatcttataccctgaaaaacctaaatttttcattatatgacttattacagaaaaagtttgctgacccctgtccaatgctgccttggactttccagggacatttctggaggggcctgttttgcttaaatcattcagagaaaagatctccccaaataatcattacaaggggctagagagagattagtaagagcaacaggccagtgtcttcctccaactccaaacctctatctacaaaggagacaaatgaaagaacacagtcactctattagaggagaaccccaacttcccaggaaatacaaatgtttagtcactgctggccctttgattcactgagctagtgaagccaggaggccagccgtggacctttctctgcctctccttctggttcaatgcctcccattcctgtccacccactgcatgcctggatggccccatgtggcttacaatgctttgggggaggcatattaatgtccactgtacatatcaaactctgcttgatttaatctctagaattgaccactgcattgattgtataaatgccaatgttgcaattcacaacaatgtcagggttattacagtaacccccaaggagaggaagaaactagctttcactctctgatcattagaataaagcaggggctgtcaccattattggtttccctctgcaatagtccagggaaaccggagacataagctgtaagaaatgccttagaaactgtgaccaaggaagacccactggggagctcacatcacatatccccacttcctgcagaagacctggagttagttatctgggccgcacggaagtgcaagtgcctgggtgccaccaggagacagccaaccagtctataaagcactgttatgtgatggggctcctaattatttgtaattggccaggtcacctgggaggctagctcccttcaacaagccagaggaatataaactgggcccagggtggaagtgaattctagaatagggaggtggggaaggcacagttagttgagtggccgaggcacagatgctgaccccaggaacttcgatctgggatcaaaacacccatcctcagactggccacagctacatcacccagagaaccttatgaatatcctaattctagagcctcagccccggtgtgtctgattttgccgggtttaaagcacactagagagagaaactgatcatttctctatgtatctggaattcccatgcatccttccaggcccaacccaagcacaacctatgtgtgtatgacgggacttgcctggtcacttaaacacaccctagtccttctcccctacatttcaatagcattttgcacctcttaccacttagctttaaatacactgtttcatgggttacattttatatcttctctctaattaatccaggaaattacaattgggactatctcttatatcttcaaatccccaaagtagttagtttcccgtgcccagtgggtacacaacctcaaagcatcctcatgtagctggccctacctgtcattcttatctctagccgtgttactttagagagggcttcttggatcatactttccagacagcacctcccagtctctttctagcctacaatgctgctttacttttttcaaagcatcctataaatatctgaaatgttattaagtactcatttgtctacctagagataactcctcttcccccagccccaccctgctagaacacaaagagataactcctcttcccccagccccaccctgctagaacacaagctctgtgagagcagtcgttgtcagggattgcatctccagtaactagaatggtgtgtggcacatagtaggcctcctggagatgttttgttaaatgatgttatttttcataggatagaagtagtaactcacctccttaaacttttttatgctggcaggagatgttgattgaatatcagttggcatgcatactacaccaatatccaggcaagtcattaaaaccctaggtcccagatacggcatccagcctgtgacctgccacaagtggtaacatcaggctaaatttaggccaccagggcaaaagtgccatgaatacatcagaatgtacatatatggctgggtgcagtgactcacgcctgtaatcccagcactttgggaggccaaggttggcggatcatgagctcaagaaatcgagaccatcctggccaatatggtgaaaccctgtctctactaaaaatacaaaaaaataactgggtatggtggcgcgaacctatagtcccagctactcgggaggctgaggcaggagaatcgcttgaatctgggaggcagatgtttcagtgagctgatagggctctgcactccagcctggcgacagagcgagactctgtctcaaaaaaacaaaacaaaacaaaaagaatgtacatacgtgaagcagctttgcgagtagaacaatttgcactcctggtcagttggacaacagctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggagaaagaacccttccatctgactttcctgattattaatccatttctcatggattagcaagacaataaactgtaggaaagccagtgtaggcattaagacccaaagctgttaatagaacaagggcagagagtagaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgactttctctatctccttgggtgcacaccagtgaaacatcccagtagagtcgtacttcttcacattggagtccatgttgtcaatctgatcattgccaggaattaacaaggggtcatgcctgggaagaaaaggacaggaaaacctaagtggaaaatgtgataaattataaatggaaagtgccccctgaattacatctcagaggatgtgaaagatgcagaggaagtggttgtcactgaaggccattcttctgcttacagaatccatcctttgagagacaactgccccaaaccaccaccccacttctggaagtgcaggtgacctttgtcagggagcatttctgcctttcccccgctcctcttttcctaaatggtcttcctaacattttgtggattcagcctccctttttaaggctacctcactcctcttcctctcattttaccagctattcgatctccccagcgtgcacacacacacacacacacacacatacacacacacagacagacacaccaaagggttgctatgagcctcggcaatgaagaggaaggaataggaatagagcctcatgctgactgactggcatgaggatggaaagccaattactcgctccttctgactacaacttctgacgtgatgctcttcgcagtaaaagctttaacaggctgcactttaaatattttagcaatttgcccaatcagattttgctctccctggctgaagcctttaaagattcagcagcatgtcacttcagagcagactgactaccaaatgcccacatctggaatacatgatttcaatactaaacaacaccctctctccttgccttgacaactgtatatgcactaaccatccaatgatgctccccaccaccttcacctcccaactgctgcatatcttagatgagagcctcaagctcagatgcatcttaataaacttgtttcaaattctcagggcaacattcgccctctattgccttgtctattggtggaaaaggaagatgcttccataaaggcctcccgtctagtgggttggcagagcctcactgacaaccttaagaactgcaatggaatcaggcagttctaacaagcttatagcacaataaataagctcctgcaccttgaatcatagtcaatgtccatgcttttatctctgatagtgattcagcacctcgggtttgggaagtcattgttccttcctgcaaaactggccatataattaggacattgtcccagctatacttaaccactcttgaaatggagctatcttttctgagtaatattgtcaacacaagacagaaaatatacatcgggtcacattccataaattgtaaagtgattttaccttttgaaattctatatttcaacatcagagggtgacttttttcttttttctttttttttttttttagacagagtctcgctctgcagaggctgacttttatttactttttactatttgtccttctgaaatgtctccgatacttcccacttatatgtcaagagtacagagtgggacagcaatctcttccatggcccaaaaacctaggattaagcttttgaataactaccacgaccctccaatatgctccccactcccacataaggtgagaaaactttctcactgcctttatttatgcctgagaatttgcttttagactacaccaaatgacaaatactatgtgaagccaacttgcaaagttatcttcaacgaacatgctagactactataggaatatctgtcatatctgatcttaaaagaagaacaatcccactccgagtagcatctcagtgtctggattgttgagaggtcttgaggtatgtaaaccaccaggccatcttccaaatactgaacttagtcaaagatgttaagataaaaaggctgataagaactatttacagatcagggtgagagcacattttgagggatgtttttgtccttgaagagtctttaacagttgcatagatatctattaatattatctggaataggtaggtagacaaaagccatcatggagaagaggtttgagaaaatgaacaaaattaactctttccagcccatgaagaacatatttcagttgcaagaggatattagcagacttgccctgaagatatagagccaggttcaaattctcttgccctgtttactggttggagagaaagtattacctcaggatgacctgagacctgcccctagtgcatttaggatttaaaagatactcagaactatgttcccataatatcagcaagcaagcaaatgaaacagcaagctgacaaaaaacacttttagaaaatgtgtgccttggggaagaggagatacattttggtttggtatacttgattctttctgggaaggagtcagacgttgttaacagtggcctacaactttcatccagaaaagcaaataagcaagcctgatgatcgatcgcccttcaataaaaagaaaaaagacagctaatgtcaagcttcattaactggggtagtggtttccagaaaccaggcataatttcacactggagctcaagccatggtttgcaatggaacatccagaggcatccaggaagtcttagaggtatgccacactacactctactccccacacatctctcatcctggcctggaccatttaaatataaacaatccaggatttcccccaagagactgacctgaggaacatcaaaaacctcccggaacaaagacattaccctctctgaccagcatggtacctggaattctaactttggtttattgaatcagtaaagcaaccaattgaatcagtaaagcaatcaataagaatcccctattctgagcatggaatggaggctacagtaatgattaagataaagtccctagtcaaagagaggtccacaagatagcaggaaaaaaatatatatacaccaatagttcaatagttacagtaccttgtggcaagtgttacagcaaagtacaaggtgatacaagaataccaagaaaaaagctgttcatatcctggtatttgggtagcattaaggaaggttttgcaaagaaagtagcatttgggccgggcgtggtggctcaggcctgtaatcccagcactttgggaggccaaggtgggcggatcatgaggtcaggagatcgtgtccatcctggctaacacggtgaaaccccatctctattaaaaatacaaaaaaattagccaggcatggtggtgggtgcctgtagtcccagctactctactcgggaggctgaggcaggagaatggggtgaacccaggaggtggagcttgcagtgagccgagatcacgccactacattccagcctgggcaacagagcgagactctgtctcaaaaaaaaaaaaaaaaaaaaaaaaattagcatttgatctgaaccatgagaaatgaagaggaatctcagcatgttgcagtgttgatccactaatagccagtaggacccacccagagaattgaggcccaaatgaaaagggccaaataatggcacctaaaaccatggctgaagatgccccataccataccacctaacctaaggtacagaagactcagaccaggccttccagctgtctccagatgtgcaatgacagtcaagttgaagatggattaaactgattgagtatgactgattgacagcagactaagaatgatccatgagattaagagagaacaaaaatcatggttccaaaacaggaagattgttataaaaattgaaagtaattcaaaaatgaaatgagttgttgcccaagacagtgggttttctatcattgagccattccacaagagcaagggatacagtgagcatatgcatataaaggttgggcgagcctagaagatcctgaaggtttgaagcactgtgctgtcactggagaaagacacagctagaagaattttgaaagtactggaccattgttggatatcagaaggctggagagccctgagtaggtaaagaaaggttgctagagtgaagatgagaggtaagcagcgtgggagagggattaatttatggctccagtaagggccagcactgttacacactcactggatttcacagtctgggagtaagctgggaacacaattcgttccagcaacaatagagtctgtaactgtttctggccagacagtataaatttctttactatggctgttgctgtagtaatttcaagtgccttaggctggcctgtgctgcagagagatctctggaacaggtggagagtgtacagtcagttgtccacagggactaaatcaaagtttctaaagcttctattgctagaagaaagtccaagcatttgccattgagcacaccaatcaacactgctgtgatccagggagacccagaggaattgggccgtttgttgtatggaaaggaggatcatgagaaatctccctgaacaagggatcccaacatcttcagtttgcaaggtgatagagacccacttccaaagcctctcccacaactcctcaaagaccagttagttgaaatcaaggaccaggattagatattgtctttcacatcataatgacattacctaagtcttccactcacaaagtaattttcaatttccctaaaaggcaccataattaattcaaggctcacttgtcacttgcgacttagccaatgtacatgccctattttagggtaatagaaactctatgatgtgagatatatctgctgtttcatttttatgggctgaactgtgttctcccccaaatttttatgtgaagtcttaaccgccggtacctcagaatgtgactgtattttgaaatatggtctttaaagaagtaattaagttaaaattaggtcattggggtgagttctgatccaataggactggtgtccttacaagaagaggaaatttgggccaacttttccacaggagggaaaatcatgtgaagacagagggaaaagacagagatctgcaagccaagaagagaggcctgaaacagatccttccctcagtacccttgggaggaaccaaccctcccagactttcatctcagacttctagccaccagaactgtgagaagctctgttgtttaagacactgggtctgtgatacttgattacagcattcctagaaaattaacacaatagcccaccttgaagaaaaacaggcacaatatatcagatatcccttagctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccttcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttccttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccctgaatacagcatctgacctagagcatgtcctcaagaagtgttaactagtcttatggttatcatcctttatactttgcttaggacccactcatgtattactagctctgattatggtgaaaggaggcaggaaagggagagcagttcaataataaagatatagagctactgctattatttctactactgctactattaatactactactattgctgctactagtgctattaccattgttgttactatgatgaatagctgccatgagtccaacacttccaaatgttggtgcactaaaacttttacctacattttatgatttgctactcacaagaacacctgtaggtaatttctgttattatcgggctctgtgtatacatgggaaacaaaatagataagtaacatgctcaggtggcacagccagtgagaggagaggcaaagccttaacaaaaaggtctacttggctgaaggccagtgctgcagggtgcccacctcataccctcccactttaaggaggcagccatatcttgttcattctccatcaaaacaccccaagttgcagtgttctaagcagccaagaaagggaaaccagcatcgcaggcatttacaaaatgcaccacttatgtgaatgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaattacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagctttgacttcaacttaaagtcaccagctgcattagttccaacaagaatcagcctgtcctttgaagctttgaagtcaggcatttacatctgtttacagcatgatctactgaatattttaatcctgctgttgagacctactgctcagagaaaaagatttctttcaagatgttactgctcactgataacgcacccaattattcaagagctctgatggagatgtataagatgaatgttgtttccatacctgctagaacaactaccattctgtagcccatggatcaaggggtaattttgactttcaagacttattacttaagaaatatatttaataagctatcactgccatagtgattcctttgatgaatctgggcaaaataaattgaaaaacttctgaaaaagaatcgccattctagatgctaataagaacattcgtgattcatgggaggaggtgaaaatatcaacaggagtttggaagaagtgaattccaaccctcatggatgactttgagggctttaagacttcagtggaggaagtaacagcagatgtggtggaaaaagtaagagaaatagaattagaagtggagcctgaacatgtgactgaattgctgcaaactcatgatcaaacttgaacatatgaggagttgcttcttacgggttagcaaagaaagtggtctcttgagatggaagctactcctagtgaagattctgtgagcattgttgaaatgacaacaaaggatttagaatagtacataaacttagttgatgaagcagcagcagagtatgaaaggattgactccaattttgaaagaagttctactctgggtaaaatgctatccaacagcatcacatgctacagagaaatcttttgtcaaaggaagagtcagtcgatgcagcaatcttcattgttgtcttattttaagaaattgtcgcagccaccacaatcttcagctaccaccccccgatcagacagcagccaccaacactgaggcaagaccctctaccagaaagaagattaaaactcactgatgactcagatgattactagcatttttaggagtaaattattttaatgaaggtatgtacacacttaatagactacagaagagtgtaaacctaacttttatatgcactagaaaaaaaatgtgtgttacttgctttattgcgatattcactttgttgtggtggtctggaactgagcctgcaatatctctgaggtgtgcctgcaaaagatctttgttttgaggattcgcagagcaagaaatgccacttggcatcaattaatctcaggaagtgaactaaatgccctgctacaacaggaacagaaaaagctcgccttgaagacaacagcctaaagcaaaaccacaaatcccttttctagcaaacctgctgtgaggaagctgatatcatattttaaagtgcacaatttcccttacaggcaaagacagcaaatcccagttccttcggtggcactgggttcaacgctggacttcagaaatttacatgaaagtacaaaaaaccagccaaacacacaaaaatgttatgaaaaaggaaagttacaaaatggctagaaaattgcattcttttctctgcttgattttcgagacctcatgtcttatcacacgataaggccttttctgtcattatgagcatcccatccaaattaagggcatcctacagtggtctccctgggagatgagaggcttgattaaaaggaggtgaatttctcatccctccacagaccttttatccgagctgcaaatactgactttattgagcatctattatgtaaggcaccatgatggggctaacaagacatttctcagacttcacagtttggctcaagtgttcctcataaagccatcatcctgaacagccagagagactgaagttattttcccttcctgggaacttctagagatgctccttcggcaataataatttccatgtctgttttatccattagatggtgaactatttaggggcagggatctattttgctcttccatgtatttccagaatccagcagaggatgcaatcaaactaactaaaggaactgatgaatcatctctagtccccaaacactcttcaagcagtcaacagagactcagcaaacctttcgtggagatccaaaacgtgtgcagtgagaacccatttacctctgatatcttgcaacaatttgtttttgaacaatcagggttcttgcatcatttttcatttacagggactgcgtatgaattaggacacagagcatttgctataaaaagggcattgtgatgtgaaggacaaccctaaattatgtctctaaccagtcaaggctgcctgaagttcgcctggagccagctgctgtaactaatcagcagggaggactcatgtcagtggtcagacagatgttcttaattaagcaactatttggttctccagtgcaaagtctgaacacttcttagagatgggcccccatcacttcaagctcctctcactgttctgattcttcaaaagagtggttctcaaactgtggcccagaccagccgcatcagcatcacctggaagtttaacagaaatgcaaatttccaatccccaggccagatctgctgaattagactgtgtagggctgtggaccagcaagctatatcttaacaaagccctccaggtgattccgacacctgctaaagtataagaaccaccactataaagttttgcccagatggagaatctatatggcttcagtaaatcctacccaagttagcaattgtcaacaacacacagattataaggctgtagttctattcagcaaagccaggactacagctagacaagagggtgcctagggtgcaaaattgaaggaggcgcctcacattctgggtgcctactctgattctctgtgactctgtggaactcgaggcattgtgtcaacacttgattcttgatggggatttactgactagatgctgcactaatgactctctcttgctgacttctcttcccatgagctaatcagcaaataaatttaaacaagcaaattaaatactagtcctcgcaaagtgcaatacttacaattcagtgttctacccttctttaacaacatggtatctagtcactaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagacaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacctaagatgttatctagtgttaggcagccagcattctcagaagaaggaaatggttgcctttatgtttgggagacagcctgggagaaccaacacgttcatcagtcctacaggaggttgtacaagatgctcttgacacaagagggcaaggtcatgaccatctgctgagcatgaacttgtccagggacctgtgtggtccacccaagcctcagtaccatgacaccaactacttttttcttctccagtcctgggggaggcctgtcatatgctatcagtttgtgcattaagagatgaatttacttagctaagctgtccctgccttccttctttcttttgcccagtggaaggaattgtgagggtgacttggctcagtccattttgccattttctattactaaaatctttcatgctagcaggctctgatgtgagaagtcctaacaaaatgaccccacgaaaggtttgagtcaaaagagaggtgatgagacttaacaagtagatgagtttatttcacttaatgaccaggagatgcccaagaggataatctgttttcctcaaatcatattttgcctcccattcaggaaactaatgtctaatattttctgggtctcctgacatgaaactctcctcaaaatgttcaatttcttttttctgggtgttgtcaattatccttgccagcccagctgggtgctatctgtgtaaactgtccacctgatacatcctatgtaaatcctaactttcactgaagttttcattgaaagtttatagggttggtaaggcccccaaattaagaactcttgacctagctatttagagacaaagtctgtgctccccaggactttacaaatgaggaaagatgtagctatccttacaaggcaccaccccactaagtagggagaattgggccacgggtgcttgatgattttagaggaaaactaggatgattttagaggaaaactctaggtctcaggactgatgtcaggaattacgtgtgtccttgggaaaactatgtatcccagtcctggtctactattctacagcagaccctgaatggcttagcacacaaacggccttggcagaggctggggttgagtgggccttctatttcacacctctgtgcttatgtagtgtgtgtctcagaaatctcctgatggaggactcccaacccttctctctgctgccaccagtgattcccccaaaacacaagttaggttaccgcctcctcgaaaaccttcaggggttccctaatgcctatgacaagcaaaaccttcatgactgggtgccagaatactcttacattctccactccatctaggccactccaaagacccctggctatagccacacccaggcatttactgtggtctgagcactgtccctatgtcttccatcatcctaattagggaaaacttacctagatttaccagactttacatttctgtacctcaacatactcacctgtaaaatgggggcaagagtaataactacttatagagttgtagttaggactcagtgagttacaggcatccagtctcggtaaacctagacaagtaatattattagttgagcattctcctcatggtatggaactaggttcaataagacctcctcctaaaccaggctcagcctcccaaaccagaggtaatgacagctctttctattctcacagcccatgctagtggaacccccagcttgttcttacccaattctgtgtttttatgtgcttgtcttctcctctgctaaactataagcattttgaaggcagggatctaatctaatctattagactgtgtggaagttctttaagggatctaaagtcatttgggtgctagactttagattccttaaagaacttccatgacaacttgcacacagtaggctctcgctaaatatttgctggatgggagctaatctgagaaaaagattaaaagcaggcagccgaagtgcacagactttttggattccatgtgaggattcagtgtgagaacccaggtgtttactccataccacctacccattggagaaatctcatcaaccaaaaagcatttgtacgtgcaactatgtggaggtggctctggaataaactgaatgtgattgtaaccagggatcctgaatggagatttcaggaatccattaacctgcttcaactgtggtaaaaggggatcaagtgtactttttattttttcctagaaagacttcctagagagttttcattgaaggttcatagggttggtaaggcccccaaattaagaactcttgacttagctatttagagacaaactttgtgcccccctaggactttacaaatgaggaaagacgtggctatccttacaaggcaccaccccactaagtagggagaattgggcaacgggtgcttggtaattttagaggaaaactacgggaggctccttcaataattccacagtaagagaccgggaaggaagggaaataacaggcagagagagccggggacttggaagcctccatggctcacacctcctctgcgggtgtggagccaaatttatccatcattacacgtgtgtcctcagcctggggcccagacactcgccattcagctctatctggacatgagggttgttttctgttgaggtgactcaaaaacatactacctcaggatccagatatacaaaacaaggctgttcacctaatgatcgtgcagagttaagtgacacttaaacactagggtaagcctgatacaagaacaaagggaaggaaaagaccattagtgcagagtccccgttgcatctcctgctggcagatgatttggaaggagccttcacgcaggagtctgttttatttgcagaagccacagtggtaaattacagcccatcctagcccattctgggttctccagttcctcttggagctattcctgtcactgcccataggccactaaaacctgcccgcattcagaatgattgattctgctcaaactgcaagtcacaaactcatgtcgaaaaatccacttcaaataagtcattagcttcctttatggatttttcaggtcatgaggaataggacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagcacctgggacatagaaagacgtggtaagggaggagtgtctaagactttctcacttgtcatgggatggcccattccagctgggctgcgaagggagaccatggtgggctggtgggataagacatcccagcgacaggaactgaggccttagcagcagcccaaaggcaaccaacatgagaagcccgagttctgtagcttggcaagtttccactcaccacctgacccacgtttagcaattttgatgtaccatgaaacagacagctccagcccaggatgactgcctccctcagcccctctccagcaacgaatgaaagcaagatccactttgaaaattctcccccatcatgcaaactgacacaggcatgcttttcaaaaacccacagccaatctgttgatcattacttatttacaaaggccttcgggcagaaagtcctgtaaaaaccatacttgatacgatatacactagctttttctgcttgtggaaaaaaagtccccccaaggctacctcaaaccatcactttctattgcacataaaatgtagcgtgtaacactaaagtatttaatatatatggtataatatatctacaggaaaggcatttgtgtagaagtatgttaccctggatttggtaatttgatgttttgctgaaggctacgacttaaaaaagcctccacctcatacagaagacctgtcatcttggtacccaagagccaacagaataaagaagtacccttaagcagcaaaactttgacacagctttgaagcatatgaaaacagtataactcctcagaattattattactcaagatcaaagaaatgagccatactttacatagcaaacagggacagggaatttggctccaaaggtttcagatttttcagacttctctttatttatttatttgcttctctaaatttaggtgaaggaaagtggctgggcttttctctactttaaatgggaataactattagaattagataaggtgattacctaaaggtgagtaaataggaaatgaatgctagcatgacactggcatcataaaaacgaaaagcttggcagttggcacattttattcctcctcataaactgtaaacaagcatgcaaatcagccaaacccaaggaaggctgggtgaagtggaaggcagagaacttttaaggaaacatttaacaggaatagatggtgatatggaaaaggagttgggcagggtgagtcttccacggaaaacctgtgtcctcaaccacatgaagaaagactgcccttgcctattttccagaaaggtggatgtggagggccaggaacatgcaaatgttattgaatatggggagtggaaatcaccactattctatttcaaaaatcaaagccggtggccatgaaaagacaaaactaatgtcaagatggcaggcatttccagagcagaaaccacatagggtgagcagtgcaaatctgaaatcactcctgtttcatttgggtggtagagagtcaggatgtcggaggaaaaaaatgctgggattggcagatgaattgaagacaaaaaggggagataaaagacagataggccaagaagaagaaactgcagaacgctgttgaaatttgacttcacttgctatttaccagaggaagccatagtcaagaaagaagtgagggagaaagagagagaaggaggaagggagggagggagggggaagaagggaaggaaggaaggagggaaggaaggaaggaaggaaggaaggaagggaggaaaggagggaacatgtacatgcatgctgtatttcataattaatattgcttttagcctgagcagaactggattacttttgaactttgctttggcaagtccacagattattagactttttcttatcagtcaaaatcaattaacagaaatttgatttcaatcgacaggataaaaggaaggtaatcttcaggttcatttttgattgtgatgatacatctcacatatggccttaagtacagaaaacagtcctcggagggactccagcagaaagagactgccgcaggcaaactaaccacacgagtttctctgattggttaccgccatcattagtgccactgctgtttaggaactacacacagacaggacatggtgacagctaagactttaaagcctatgtatttttcaaacagcttttcaaactgtttttcatgacagaattttttcagctctatcattaactgctgacaagctgacagaataaatactccagcctttaagaagccatctaacgatctcgctcccctcccccaccccgggcttgctggggaggggagactctgggcctggcagggtgaggagagggcgaggggaggaagagaagggctaagagggaaaccgtgggcaaccagcccctctccttacctcatcagcttaggcgaggtgttgggtgagttccgcatgcctccattccgttgctttttttttggtgatagtgttgacggctgctcatcttcaactggaaatacaggcagctcatgagattatgaacagtttgagggcagactgtgcaatacaggcaaaatatcaaaggacacacactcaaggctcagtcactcactaggaattcatggctgtcttttaggacccaatgacaaagaccaaatgtgttagtcaaagaggccggcttagagaaggtgaaggcaacacctctttacactccagcctttgaacatacactttaaacagactaaaacagtttgtaaacaccctgccataagaaaaaaaaaaaaaaaaaagaaatcatgatttatctgtataccaaaaaaaatacttatcattattcttagagttaattttggttactttgctttgcccagtaatagactgcgttttgttgtaaccaaaatcagaaataaagttgtatttgaaatgtcagcataactgccagcctgctgcttctccagatgaaccaacttagctggttcctaacccctgcataccagagaaagagcgttgaaaagaggcaaggattcaaggccttgacagccaatgtttcaatcagatcggggcacattggtgcatgctggctcaataatccccagcccaactcagctcttatccctccaactgccaggagggagggcttgtggggctgtgccaacggggtcctttttcaacccatgaagacaggagcaccggggctggtgaggttggaggagagccccggaatgaaggaggaggttgccattgaatgaaatctctgatgatgcagcagcggggcagggatggagggcagcacaggggattggaaaccaaaagctgttttccaaatgtctaaaccacacagattgctaagcaatgtgaagcttcacttagaaacaccacagcacactctactgctcttgcccaaagacacccactaataagctttgcagatgtattagcctgcatcatgcttctttttaagagaactgcttgataattagcagatgcaaacccagcctgtcacccaggggcatcagcggcaaaattctagtcctcctctccccacccccacaattcaggctaaagctgtaatatcaagaaggaaaaataagatctttggattcttatagttgactgcaacacagactaggaggaaagcaccctgaaactcagaatgcacagcagttaccttaaagctaagaagagaaatattagcagtgatgacatcaaaagagacttgatatatgttaatggtgtaggagtcttagatgggggagaaagtgccatgtcagctacttggtattatccaggaagacccatattagagcatgcattatatggtacttccctgaaaacgctaaataaatttagtaggttatgatacatgcttccaaagctattttaataatccaactaccctccaaacctgcttcaaagtattacacattttacactctcctattctgctgtcagtttgggcttgtctaaaccctggctgatgcaggaaaagggaatgactgtggtgtaaggtgagagtgagaccagaagagatgaaggcaagaaagcacctgcaaacacccacagccgaccccctgtaccacctgcttcctctgacacccaccagggcccaagctcaggccgagactgtatcagtcatttagagctccaggcagagactatgtggctgggatgatatcgcatcttatcagaaatgagtatccaaagcaaatcacacagagactaaacagcacttaaaagattaaaggaaataaatacaagccacataaatggtattgaaaaaatcacttagagttgatatgcatctctcggcaagcaaacaggcactctgagcttgacctgaattcatcttcctttcacaggataggggaccaggcatctgaggcaataatggggtagaaaggcagcgagggtgtgtgggtgtgtgtgtgtgtgtgtgtgtgtaggtatgctttcgcactttccccatcttagaatgaagtagaaagtcttgcactaactagacgtataagacaaggtcatcttttaatatgggccacttgcaattggtgtattgtgttcagggtgacctagactggttgtgtagcatgctggagcaaataacacgtgtgtgtttgtgtgagtgcatgtgagtcactctagtcggggtgcaagttctgtttttctcatcttaaggttataattcagttagacttcttaaggttataatcccacatccaaaggtttttatctaacctagtctaccacggctagcatttttcaaggtcaccagatgctaccatggttgtgtccagttacacaatgaatctagatgagttaagacctgaacagaagtcatcctccctagcatgcctgtgggattattttgctgagcattggcttccctttttgcattgggcctataacaaataatcctctttggttaagtggccattatctttacaccttgttgctacactgatcttcagatgggagagttgcaagttaatacctgttagccagctcaagggagacacctcattctggtagtaaagttatgcctcttctatgcaaagaaactatttattttcattgcaactcagaaagatcatccatcgtaatcatactgcatttaaagtgggatttgttctccaaaatgaaacttgtgtttaaaggtttcctcctgcactcacagcctaaaaatgcagatctgttccctgaagagatgggggaaaatgtctccagcttaaatatatgaacgctgtgtaatggagaccattacatatggcttaggtccctcaagagaagcagtgataacttctttctcataagtaggatataaaccatatttaattatcagcctttatatggatcctatcaatttctgcataaagaaagcagatctaggaaaacttttagttaagctataaaatataattttcatttcatggcttctgtgactacatgagaggaataaaaatggaattaaaagggagacttaaatttactcactttcatgaaagacaaacgtgttgaagtagtgggccactacctcatgacgatgcaaatttacaagctcttatttaacctacattttggctaattacaatacacctccatctatggcattttcacttgccttcatgctgcggaagccacatgaagatatgatcctttaaagaaacctgacttctttagaacacaaacaagttcaggaatctaacgtggaattttataggagctgaactccatccagtctccaagtactcataaaattcaagggcttgtttttgcacatccctaagtataacacttaatgtgctgttgtaacttcccagcgctcccttgtctaataggcactgaatctaacagttttacagtttgggaagactcagtgctagaaaaatgtcaggcaagtctaatgaggcttcagatcccctggtttgcgctagagtttaatttaaagttacaatgatgttttaacatgtttgcttatacttgactaaagaggattcgttatttcaatgacataacctccagacaatgttctgagaattgatttaagatgtggtggtaattccaacagccttaatgcagagttgaacatctgtaacaacattttactcgacttttcatcagcattctgttttcaagcaaaagcaacgtcttccagaaacactggccagaactctgggcttacttcaaaatgattacatatttcactagatttttaaaaaaagaaatatcttcctttatcagccgcgccagactgcaaacactgtgtcagggtttaccaagcctctttatggtccttggagtgaaatggggcaatgattgcaactcccagccttccctaattcagtctaatgcctgcattagatggacctgatgctcagctctagcctggggcacattccctctgccctgtttccccagtgagatttaaggggatgatgccctttaagatttaaaggtgagtttattggctggagttaaaaaacagttcaaagcaaataaactcagaaacgtaataaaaggcaaacaactcataaacatgagtcaaccgctatctccattatgttattaatcaccacatctggagaaacccacatctgtacacacttagcaggtcattagtaatgtcatattcacactggagtcactcagaataagagtcatgcaaagtggtttgaacacaaaggcatctagctaacagggcttccgactgaagtcttgcacaagctgccagtttgggggtgaggtcgttttaattattattaatcgttttttacggttttcccttttggtattttgctgcccaacaagctaagtgcaagctgaaatccacagtagtgcatcgctcttcttcaactgagctcagcatggtaaagtagaatgttgagggctgcagggtagttattaaaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccatttttttccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaatgccgtgagtttgccactcctcagaaagacagatccacggcatttccttcggccgtcagcgacaccagtgaaaagtgggtgtttcaaatgttgttttactaaaatgaagggtatggagtgatggtaaaattcctggaattttacaacagtcgtgttgcaaaatgtaattcaccatgaacaaaactcccaagctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagacgggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcactaagaagtttgataagcactgcagtattcttcataaaaatcaactataaatctattttttgaaagatcgtggctaatattttctttttctgagacaaggggtctttgttgcccaggctggtgtgcagtggtgttatcttagttcactgcaacctctgacatcacggctaacattaatccacagattaggaaaagaagaaagatgctgccccttaaaagcaaccccaacgatcataatatctcaaacatatacacctctctaaaatcaaacaaccacattatcatatacattattctggcaggataatttcacaacttctagctaggaaataggaaacacatttacttggaaaacctaatgggtatcagtttttaaaaaatctatcgttatgcagaataagaatttcaaaaaatgtctaagtgacctgtactgccctaggacaggcatagggagtgcccaccccatggtaggctgccagggcagggaagggaggcttgttggagcttttgcatttctggcttttgtggagctaataggaaaatggggagggagactttaaggaacaataggttatgtagaagttaatcacagggtgtatttctggctctattcactgcctaggaaacctgaattgtgtaagtttgagtccatcaacacagagtaatgaaagaattcagctcctccataggagagagaaaaaaaatactatataaatatatgaacagaatccacatgacatggaatgcagtgttctctacaaaatactgcgggcctaatggatcctctagaatccaattgggtaaattagatgtgcccatgctacccatgccataggccctcaaccccaatctcaaactatgttctgtatgcatcctgagaggaactcagcatgtaccaaagccccccatatctagaatcgcagctcatatatcttcgctgtagacttgacctgttagaatcattgcccaacactccgccctgttcagtattcagtagaaaatccttttggaattttctggttgcctttagcccttttctttttccctggaatagactctctattacctcaagggcaaagaaaagtctcaagcaaagatcactaggtattagtttcttagagatgagacacagagatgaacgatggaattctaagaggaaatgcacaattgaaaagaaaaattcgagaacttccctgaatttttgctatggggtttggagaatgggaaggtactaggagatgggagataatttttactttacatccaactgggagggctggggaatgtatagaagtccaatacaaacagcccctcccaactttcctttccttctctccctactccctactcctgacaccaaaagccaactttcggctttgtggcaaaagttaaacctgactcctttaggttgccctagcacttgcagtccgcgtttgtgagggacaacttttagagtagggatgaaacctgccacatcctgggcaccaacagctgcttctttctcatctttctcaagttcaggggtcagcaaactgtagcctgccacctgtttttgtacatcacatgagctaagagtgtgtttacatttttaagtcattggggaaacaaaatctaagaataataatatttggtaacccactaaaaagatatgaaatttggtggctataaataaaattttatcagaccatagccacagttgttggtttaccagccatccctggctgcttccatctctaacgacaaagttgaggacttgccatagagaccatatgggttgcaaagactaagatattaactcgctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagttagattcatccacccagtactttggaaagcaaggcgaaccacatctaccgtgagcaattcctcgaagctgtcagcgtgtgctgccagtccaccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggatacatggtgtggcagtttcactgtgaatccagaatgatccagacggctgctgtctctttgttaacaggaagccaaactgatgagtttgtaatgcatttcttatcaaaggtagtttcagaaaagaaaatgtgccccatcagtttggctagaatttcacatacacaagattataggcttaatcagaatatctctgttattttcttgaggaaatagataattccacatccattccattaaatcattttatgccaatgaattatgtatttatgaatttataattatccttgatttttcttccccttttgcagtctacttaataaaatcatcagctggagcttacaaagcaatagtgcttaatagatacaagcatgctaatatattttttaagtgaatgctgatctttctgagctgtgtgtctaaaatcatcattgtgaataaaagaattgtaatttccaacccatacatttaacaaagacaaagtggactgtaatggaatttatggagcctgtaaaggaactctttttctaagacggtttataatcaaatagatttggatttactgtaggtcaaatcaggtcccccgatgtgtatcaagaaaaaaatgcctgtaagataccaaacactgctcctggcaccctggaagggctcacacccatggctacagctgctagtttcctggtgtcctcattgtttccacccctagtgaattcagtacttaaatgtcagctttgaaatcaatatttatactgtcttcacttaaaattatgacattctgttcatcctggattttttaaattttgattattttgaaaatattttattttgatagtttgaaaatattgcatgaaactatcatttatcttgattcctgaggttttgggtctcctcttaaatttggtgcccagggcaaaagcttctctcacctcgcccaatttccagccctgaacaccatttctcaaaggtgtttgaggtactggttctgccaccccacagaactggacaaggcaaatctaacacaagacttatttcttttgatcacttcatgctgtttgcatgagattgttaaggaaggcccttgcaacaaacacttcctcgtggatttacaaattgtcaggcatcccaaggagtggagaaaagatcatgctgcctcaggaatctgagatttgccacctgcccagagtgagaaacagaaaagagagctggggtcaggtctctcgtggactttatttcacatcccacatcaaatcctcctggttaacacaatgttgatttacatttccactttggggtgaaagtttttatttgcttacatattttgacaccaatgttactttctttttctttccccccacccccaaacaggttcaaatagccatgactggcagaagatgtcaatcacatttcatttccattttcactttgctgtttacattctttaaattaatgcttgccccaatgattgtgatatttaaagaccagcctagaatctaattgtgtatatgtgaaactgttttctaaaccataagatgttatataaatacaaaccactattattattaacattattactattggctcatccggaaataccatatcttccattgagccaatggtgtcaagagccccctagaattctaatatatattccagatgggtgcactgataatttctttcaaactcagataaaggtaaaatgcatgggtttttagtgcaagccaggtgcccgacgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgggcctttctggtcaatgcattggagaacaaggtgtggagtgcaacagaagggctggaagcggcttggggatgctctggcctcaccctcttttgcgtcatagctgcactcatacgcagaccctgacccaggacccaggtcggctgacttctaattcagatcatttgctgccagaattctgcctgtgagtgagaacagcatgaggatatgagcttcttgagtcagtccacctgcccaagtcccagctctgaccctctttagagctctgatctcagaccagttactccatacctcaatgtcctacgatctactgtgatccctactggaccaaggacaccaaatttcggagatgctttgggattatgtgacataaccagggggctgcaggctgacagcctgaggaccaactactgtccccagtgtgctgagcttggcaccaccctgctgatacacaggatttcacatgtgggacaatctttaagtctgaagattgtccatacaaatatggatttctaacttctaattaaaaatcttgtagaggactgagtcttcattccaaaagggtgccattctcctggggcaggagcttatcagctgctcaaatgccccactgctgcctactgtacccccatatatagggcagacaccccatgtttgcatttctggccctggaaccagtgacactcaagtgtaccatccccgaaataaagattttaaggcatgggatatccctccacaaatgcctactcacattgagtgggtagagaggttaagagttaaccacacaggtcttaaagccacattgttgggtctgaacctaggtatttggcaaattatctaacttcagttttctcaccaataaaatgagaattagagtacctatctaataggttgttgtgagaattgactgaaaatgtgaaaagcacttaaaagaattcctggtgagctctttctaaatgctacccatgattattgccttggctttgaagagtcagagcaatgagagttctctgctgctgggtccttctccacaccagtctgccacatttggacatggtgtaattcacatgggtccatactctctctccttccccaagcaattgagccgctaaccaacacttagaatggggtgagcattcccacccccacctgacccctagccttgcatctcattcaactgtcacctttgtcccttgtttcatatggccccaatgaagtgctcaagtcaaataattaggttttgccaaatgtcataaaaacaagaaaagccagaaaacgtttaaacggacctcaattggagaaggctggaaccattcagggcaagaacaaatgaaagacagatggggacagaggaaccccactgtttcctctaaattacaggaaattcacgccgtctgattgtgagggcctcttttctttcccttgaatttctgctgggaggtcatgggattgatcggcgtgtgcagacacatgggagacagaagaaggggcagaggcatggcggggtagagaggcagtgactccttcaccaggctctcccaccatgtcttcctttcacctgactacttgaccacccttgaagggacagcctaggctgcctcctccagggggccttcccagatgattatgacaagatcaattctctcctttctttaaaaaatcccctggcacttctgatctcatgccttgcattattataatttgtgttcaattctaatgtgttctactcccccagctaggcttataagctcctctgttggagttcacatatcactgagtctctcacaatgctgggccctgaaaagttcccaataaatagctccgagcagctacagaggcgatgttgcaaaggggagaagcacagcttagtgatcaggagccccggggttctaggcctgccttggatcaactgtgtggccttggcaagacacttccctttcctggggggatgagcattagttaagtatgagacccttctggctctgatttgtaatgactctgagtttaatgtcgggcatacctttttcttgttcttttctttaaaatctttttaaagatgcacaataagagagaaccacaagcctagccagagaaattagataattgcattaaatacgaatatacgaactcataagttacataaatgcaacagtacaaaagatgttgcatgagaatgtcaagggagggctacatgaaatgtcttagacaataagttaagtcctagagagagaattgttcaggaaaaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttgcaaaagtctatcagaaactgcctagctcgctcagcccactttcctttccaaggtaagaaacacacattcatgcatggaaataaagcagggaggcccttggcaactgtccagttccattgaagttctcatttttcttttttttctggagagcttattcaacaggaaaataaagttatctaatgcctcagaaaggggtcccgtgaaactcacaaggcctattcctcacagcccagccaggtaaatttaccctgatttcaggatggctatttcttgtcttcaactactccagctgatcccatcccctctacagagaactggaaggaaacccgtcagggtttgacttttacatgaaaactgactgcaatccatattttcaaaaaatcattttcaacaaaaccagtgctttaaaatagattcactgagaagaaaatgtttccccaatcctctcctccttgattttgttgaatcaataacatttcaagatgttctctgtgaaaatcacatgggtgagttaaataagaacatacattacattatctagatcctcaacttgcagcccttagcgcagtatgcctgagaaaagtttaaaaactcaaaagagagaaatcctattcaaagagtaaaatactgcctatgcttccaaagttctttacggcctgataggtagaaatttaataatgaagggctgggaatggtggctcacatttgtaatcccagcactttgggaggctgaggcaggtggatatcttgaggtcagttcaagatcagcctggccaatatggcaaaaccccgtctctaaaaatacaaaaattagctgggcatggtggcatatgcctgtagtcccagctacttggtaggctgaggcaggagaatcacttgaacctgggaggcagaggttgcagtgagctaagatcgcacaactgcactccagcctggatgacacagtgagacactgtttaaaaaaaaaaaaaaaggaagaaaatttaataatgaaaaacataaacaaataagtgagtcatcctgagacatatttcaattctccccttctgtaacctcaataaattcattttctcccacataagctaatgtttgcactaaatattctgtacaaaggaataccgcagaccataaaaaaaacagtaaaaagatatagctgtgtcttttttaaaaaacggttgaaaaattgggtatgtgtggacaaaataatttttaaaaatagttttgcttgcacatttgatttctctcttcatttatgatgccctagttgatgagctgatcaacttttctgtgaaaagtcttcctaaaaaacagaacaaaacttaacagaaactctgatcctgtttgtcaaaatgtagttctggccccgagagaaaggcaatattctttggatgacttggattctaaagcaactcttttattagtattattatttactttttttttttgagacggagtctcgctctgtcacccaggctcccaggctggaatgcagtggtgcaatcttggctcactgcaacctctacctcccagttcaagcaactctagtgtctcagcctccaaagtagctgagattataggcacctgactaatgtttgtatttttagtagagacggggtttcaccgtgttggccaggctggtctcaaactcctaacctcaagtgatctgcccgcctcagcctcccaaagttctggggttacagacgtgagccactgcacccagcctggattctagagtaactcttgatgaaagaacatcatactaaggtgatttttatataaaacattaattcagtatatcaatcagtcactttaataaaaatgcccctcattatcctgaggtgaatagaagcctatgggattaatttgtgtaaatagatattagattaaaatgggaacttgccacataacaataatcagatagcataggcaatccaatctcagtgctgaatccagtattgtgtgtgtagttaccttttaaaaacagtaacatgtatttaacttggacttgcttcaagtaagcactgcatcaggcaagttggatttcaaataaaccttagcaattgaggggcattgtcgtactggaagtatatctcttcaaacaacagcaacaacagttttagatatttattttagagaaataaaggagacaatctgcaagagaaaaggcagaaagtgaggaggaggagagtacctagaatccaggtagagggtttatttctagaaaagcagcgccacctgctggtggacctgcatgtcaggcccttctgcggcttgcaggccatctgtcttgcaatctatgcataaatacacagcagtatttctcagctgctgttatacgtaagaattgtattaccagtaggcagatttctaacacactggttgtagtttaataatcctatattacctgaagtatgggttatataaaaacctagaatgttaattgttgacaaaccaattctaatatgtaaagcactgtaagtcacccagtaaatacacaagtaaatcaaaagggatagctctttttgctctaacaacgtgttattaaaagccacaacttaatcacttacataaaaataatgttcatgaatttcgatgtactaagaaatcaggaaaatgcattataatcttactaacagagcttttccttcacttacaatttagaggaaactattttgcagaaaatatttttccctttctttaaaaaatgtacctaaaccaacatgccatttaggaaatttgctcctataacaaaacctagttacaaacaactaagattacatctataaaatgttatatttttaaaatagcaatagagaagttgtggaaaatatgtcactgatacagtgagcagagaaacactacctgtcatttttcaggaaaagatcacacaaacgcgatagcaaaggaacacaataaaaagcagaaacaggaatgtgataggtgactctgattgcatctgcaaaggaaactgtgaaataaattaacacccaagtacccaagaaaggcacattgtggcttcactggaagtgatcattatgcaacagagaaggttggtgattttgtaagaacagaaataaagtgtagcctgtgaaatctagtggtgataactaatgaccatactacttacaactctgatttgatctctaacataaaaaaataaaataaaaaagtactctaaagaatagatgtatgcaatagggattgtgtttctcacttgaaacaaataaacctcaaatgggatcaaagggccccggtaaatgaaaaatgacagttcctatgttgccctgatttgatctcaagcaaaactaccatgctgataacatagcaggggatgtgaggaaggcagtggagttcttggattgctatgaaaaggaggcgagtgtgtagcccattcagctgatgggaagcccattctaattccaaaaagttattgagatttaatctctaacaacaacaacaacaacaaaataactcatgcggcaaccaaaagggtatcctttaaaaacacacatacacaattttgttatttccaatacattctgtagaatctctttacattcaattcttccatctgtctaagctgggtaaggcacatgtgtgaagagaaccaaatgtcacaatgcttgctttgagaacgaagtgtctccagttatccagacagggagcttgactaggagggtctcaggcataggccatgggcatcccatctcccatctcagctggctaccactcactctggagagacagggtttccaggagcaattctggacagatgcaaagggtgaaggggaatctggtggggttcagggctgtcaagattcgagttgggggcttaccctgcctagatataactcctagtgttagcttgtgtattagtccagtgagataaggtctaggccattggctagggtctgaacaattaaaggtgcacaccctgccttaaatatccaaatttatttgggataaattcaaatcaataaggaaacataggtggatgaacagaagcaatgggtttgccatggcttcctaccccgactcaaatacccaatgacatatggaaggagaaaacatcagcacccccagatccactacagagcccaccatgtgctgtcagcagaaacaacggaacaaatgtgttaccttcagaagaagcagtgatcaatttgagatcaatctattcaagagttgtccagcagtcaaaggaattggctgttggctgttcagaaacaaaggttctgttcaagaaggtataaaggaacaagaaggaagaaaggaagatctctagccttgagacttttttttttttttttgcctctggttcagcttctcatgaaagacctttttccttgagatacatgcttaataaactatggaaacatattgtcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttccgggtgggctagttaagaaggcttcacagagatggcagtacttgagctgtaccttcacagcagaggttggccaactttttccctaaaaggccagatagtaaatattttgagctttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagttttaatctgctagaagcagagaggaaaagaatcacagtctcaggaaaaggttccagaaatgtgtaaagtaatgagaataagacgcttctagagaattgttagatgatggatgcttatgtggagaacggaactagggaaactggttgaggccaaactgcaaaggctttgaatgccattttaatagcagaaagttggaaattatcctcttaaaaaacaaggaaccatcaaaaggtctctctctttaaaatgggataacatgacaaagtctgtgctttagaatactaaagttggtggtggtttggtggcaagaggaactaattgaaaggttgaagggcaacaatggcagactagctgaagaagaaatgagcatgtgagcttggcagtgccactggcaatggtgagaaaaggttcgaaatgtaatctggaggccaaatcagaggacttggccatcggtaggaggaaagagagagtgttacagggtaaaactcagaatttcaaatgtgcatattgatactcattccactcatccctagacctatccacacatcaggtctgctgaaagaaagggatagtggtaaggcatgggtgaaaaacttgggcccagtcttggccttgctccaagcactcatctaattaattacaaaatcaacaagaaacagagcccagctactcataaagcaaggtaggaaaggtgatgatgtgaagtctcaacaccaactggacctcaaagatatggccagacatggtggtgcacgcctgtagtcttggctacttgggaggctgaggtgagaggattgcttgaacctaaaagttcaaggctgcagtgaactatgatcacaccactgcactccagcctgggtgacagaaggaggtcccatctcaaaaaacaacaataacaacagaaaaagatgagttgagatcaagaccatcatcaaaaaagaaattttgatggaatttgaaaggacaggaatgtcttctttccccatctgttctcctctttttgtgttccaactttccctccctctcccaaaaacacattgaatttgctgacgatctccagacctattttagggatggacaagccataaagaaggggtttcagggggatgaggaatgatgagacctgaagtcacagttttctaatgatcccaggacctaaggattctaacagctgggctaaaatctaagacacacatttattttcatccatcaaatctgtactattccaactaggaagcctcttttgcctggagatggtgtccccgtttggccctatatgcttcctgctacacgatttcattcctggagacctggcaataacaaaacaaggtgtaacaaatatgatgaggaggctctttggggaggtcaacagttagcattcattgtgggagggcagggccatttgtagagacactgcatatgaactggtctgggatagcttcagtagctgacaatgttctgattactaataacccccaaatcactggagcatagataataccaggaccccgggttagggagagggcctttttctgtgctttccttgaggaaaataaaagacaccttggaagaaaacaagctgacaataaagtagaaacctgtaagaatcttctgggctctttcggtgtgtccctgtgcgcccagttcctgccctagaagctgcgaactcacagacagaagactaacactgatatactacgaggtttctacacacataattgttcctcacaggacctaccacgatgttgggtaatagacatcagcattttagaaggatttataacagtaaggattgaagcaaaaaggacttttagcctttctcaatcagaagaaggaagataatcagagtctcagagtttaaaggaaacttagaaatatgaccttccaatttcctcattttacacacaaattttgcaaggcctactggatagtcaagatggaaatcaatgttctggggagatatagctgtctcttggtatttttgttggcttatttctgttgggacaattattccatgacctagaaattaaacaaattgactccatttaacttttatagtctgttatactaagctgttcaactctcagccactatctgtgggcttctctgcctgtagctgatatgacctcttataaggctagcttgatgacagtcagtcatttgaaaaaaaaaaaagcactagttatggttaaagtggcttatcattattatttccatcaatactatgggagatggcaagcttctgatctagcagtccactcatccgctatgtgatcttggtcaagttcatctctgtttctttgttaatttcatatgttaatgaaggatgataaaaataataattcaacatataccaggcaatctttatatatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataagacattactcttattatagccatgagcatctacttggtgaacatgtcaaagcatgacttcaccaggacttacttccaaagtttccagaaaattcacagatctcacccttgtatctgcctgctctgacgtttcctagaatttcaggctgtaattgccaacaagatctctcagttcactgcacagtgaggggaatggcatcagaatcccctaacatagagaggaggaaatacaggagatgtctgcctgtttcccatcttcatcttaatagaagatgtttgtgaaggagcagtgtttccagcaaccagccccttgcaaatttcacattcatgccctaacttccagaccctgtgacatgacctgagccccttcctccctgtcttcattcctagcatagttgcagcttttattttcacctagcatctctcttctctgcaggtcattgtgcatcccttctcagtaacatctgtttagggctttggttttgaagcatccctgctggatatgttctctcagttggatacgttacaggccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgcgggaggaatcatttgggtgctgctgttgcattcaagctgcctacctcgagtcagagtcaaattaccctgaccgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctatatgtggtagtaaccctgccactcctcattggaagcattggtggatttttgcctatgtggttttttctggtactttgtttccagatcttctttcccataatttatccttcacaaagaatatcaattgcacctgccatttgatcattttctagttccttcagtcatgtccttgttctttcttactacatttttccctcttactcttcttgtacatcccagttttttatgtttacatatatatactatatagtaagttgctgcttagaaagttttgggaagcttcatggatctagggcgatctggcttctagcacatcaccaattcctttaagggttgggaagcccttcatttattcattcttttactcatgaaatatttactgaactggaatccttcaggccatttcctattcaagtactcttgccaatataggaagcccagccaaggatgtcagcatgctacatttttgaccttggagggagggaaggcagcccctgggtcctttcttgactgagtgtgatccaacaggctccagcccagaaagctgacattggccaaaatgaagatcattttaatgcaagcagtcagctcccttcccagaagatagcccatgctctatggtgtgcagatgcccatctatgcactgtcgatacagctggtgcagtgccagctctagggctggagtctttctcacttcatttataagtctctcagtgcagtcgatcatccctaatgcagatctgcctcaaaagattccattttctatttgcatagggttttctctgcagctctaggaacatttggtgggactcatcttgcggtattgaaggggctagaatgaaaactttcagatttactagaaaaggctgggggagttttttcttgctgtttcccttgaatatgagagattagctccccctgaggatgaccaaatgagatggtctgagaagaaaggccacttttgttagtcctgctcatctgagctggacatcaaaagaatgtctcctcagaataaaaatctgtgggcatgtgtagcaatctccctccaaagcaggcactatctagctatttacagaaaggcctttgcaattccctctgagatttcaaatgcaagggtctgacaatgctggatttagctctgtccatttagattccctttgggaaaaaggtcagctggggaagcagaacccctgtaagcagatgtggcgatggagggtcccctgactatccaggtaattcaacaagctggtttgggagaaagccccagagagagaaggacaacacacagctggttggcttggtgcattttgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggttaagtgtttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctgtcaccttcaacacactcaagatgtaagatatatttgaactggggaagatgatgaggaataaggaagaaataatggttaggaaaaggaaacagaagcagtagatccccaaggccagtggtagtggatgcagccgagtgggtctcctagtcctgggtcaggggtcaggaaatcttcctccaataagaaggaaactctagcaaacccagctaggaatcacaatggctgccaggtcagctggggagaattaggctcatggaattcagctgctccagagccactaattaaactgtcttttaaagactgtaacttcttggatttgcatctgggcaatgtgcttcacctgcagggtcctgcagactatagatcaagtcttccttctgaaggcttctcagaacagctggggcccgcccacaacaggctcccctctgtttgtctcctccccgagaggggggcttccagctcccctctagtcagtcccttcctcccctgcagccacagcagccctcccaaaacaaagcctctgttaggtcacttccctgatcaaacaccaatatgatagtgtcgcactgtctaaagactttctatcatattacagactaagaacaaaacccttggcctggcccctgccaggaatggggccccattttacccttcaggggggtcaattccctgcatgctaagtaagtcttaaactctagccaaattgggtggccagctgctgtgcaggaggcccccccaggactctctacattatctcgaggtttcattaccagaatcctcacttttttctcctcccttggagattaagtgacttatccatcatattcaactgcaagagtaactgagcaactcaaccgactccacactctgtggagccacacggcctgtgttgaaatcccagctccaccagtcactggctatgagacccttggcaagtcatgagactgtgacatgaggctatgagacccttggccagactcactggctatgagacccttgtgccttagttgccttatctgtaaatggggcacattgcagatgtctcaggttatagttgcctcaactgcaaacagcagttaccacataataagggttaaattaattaatatttgtggtaatagggggagtagtgcctgtaatgcagcaaatgctatataagtgttaaatttaacaacagcaacaacacatacacacatcctccctgtgtactcagagttgcttgcacacagtaagagtagagactacactaattctagtcgtaacatgaatccaagttaaccaactagccatttcttagtaatgctgtgtcaacaagtctcactcccttggtgatgcagtatacacagaatatagatctctttggggagtgaccccatgctcagataagactaaaacatgatgctagcctcaaaagagaaacataatttttcagcaaatgttggtagtatgcctccctctgtctctcctcaccaatgagcatgacctgcttatgattactaggtccactccattctggtttccatttttggctgctctgtgcttgcagcttctaggcttcactgggagtcaaagatcccaaatgttaagatcgttttgaagagcatgctggcaaatgtcctaaatgtgctgggccagatgacaagcatccatctccgatgaaggaagtatccaactgaaatgatgggcaccatatgagaaggagaatcccaaggcatgatggaaaccacaggtgctgcagacccactgtccgtttctgtctggatggggaaggaaggcaggatgcagtgaagcctgtgccactgccccacaagcctctctcgagtgacttcacaccattattggtctgatactaatttgagacaatacccaatcacatcacaacaaattagccacagacacgtgatagcaatcaactcagggggcgatcctgaatgcgggctgggggattctccagctccgtgagccgcacgctcccacagatgtttctaaaagcgtcttcccagaggcccatttagagagaaattaaatgcaacttcgacttaattaacgttttaaatgataatgaatacaatgtagattcataggaggcatttacattgtgttgtaaaattgataaaaatttaataactctttgttaataagttatgtctccccagacccataaagcctaaggcgctgcaaactccacactgggtctaatcgaggctcctggtgcaggtggaggaaagaggcagagacggacttgacatttgctccaagcctgctctaattcaaacctctgcttgttcatcagtactttatttcatacagtaaaggtcaggatttgggctcaaggcagagccttgacaagaaagctcaagtggaaggcgggctggccctggcatctgtcgcctgagatagtggaggaggatggaagatgaggagctaactggccacatctgccctccaccatggaggtaagaggaagcattcactgcctggtggtagaagctgtcaggatgagtatcctgagaaccggccactgtcctgaaataaaaaagcaaacataatttctatgtcaccttgcataagggcctcttctgggcttacatgaggcatgccaacatcttttctagtttgtccttaaagagccgagtcatttattacagcatggtgtccctgggaagaaaggtgtcccatgatggggtatacacaaaggaccctgtcagcttccctcattctgacctttctccttcttgtttcccaatcctgtttcaaagaatttcttttgagaagttggctgccttttgcctactgttcccgtctcctttcatctacctgcagtacatcttcatagtgtattcatcttcaggaattcaaccatactctttttttggaaggtggtgaaagcacaacaaggtccccaaatacaagccagtgactttacctgacactcaactgaaacaaccagctatttattctggagaagaacccagtgtgttgggagctcttgacagatgagcgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccagtggctgcctaggccgatctgccactctgtttttacttcctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcctttttctgtctttttctcactggtagtggtggtggaaagaggggagtaattgattttagggcccagaagtaaaataagcaaatagaatttaggtttggggaatttgaggaagtcacctaaaactgcacataaaaggaatgagataattataggctgttgatttttaaatgtagcttattaaattaactctcctttaacaggcgttggagactgtcaggatagggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgatattacactaaactgattttggtacgtctcccttcaacctaatcatattggacttctctcagcttaaccatcggagttgaatgccttcttgtattatatttatacccaaaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgccagagttactgatgctttgtgactagaatcatgtcaggcaggtctcagcaggtctgaatcagtatggccctacgttgccactgcatcataattttaattgtccctttctattacatttagcaatcagatagcaggcaagactgaaataacaagaataaacttctaaagagagagaaaggtccattttacaaaattatagtgggaagaaatcgtactgattggaatctacttctatatttatgtgcatgtgtatgttgctagacattcattttttacatttaatagtactagaacacagctacttgtgaaaaagccgaggcccataccatcctgatgtcttttgagagagctgggactcttgcccaggaccatctgaagtggaaacaaaaccaagatgatcataaaatgacactctatgcactgattctagcctaccatattgaacatttcagtcttgccagaaataaaatccttttgtgatgaatccttatcggtcacaatttgccttacttttctgacaccttttattttgatttttgtctttcctaaactagtccttcccctctgaagttcttttggtcaacacagtctggccttccatctcctcctgagttcaacagaagacaactatcataatagcacatgactcaaccgatccacagtaatgggccacacctccatagaggggtgcaccgagcaggcagcccctgttgttagaaggcaggttttcagaactgtgtgagcacttttaatatattaccattcctctgggaaccagctacttctcttcccacttcacaaaacacataatgggactttgtgtttcaatttaacatcccttgaaaacggaaatttttccccttataagaaaaaaaatagagtaaagagggaaacgaaaggaaagagagaaatgaattaggcagtctccaaagcacactggctcaactgggaaactgcgaccaaagcaagctccataatagtataatgacctttaatgagtgtcttgggaaacaatacagccctagcataaaagacaaagggcaaaactcatcatggctctgctgacactaattcaaaatgattttcagaacaactaaagaatgtaagagaagtaatctgatccgcccatctgacctcactttgattcaagggcccttctcctgccatttctaattgtcaaaccctctacatttcacatctgttcatatttaatgaaaagcccactctcaccactgctcttgagtcaacttgctctgtcaaatgggcaccacccaactccaccaccagcgagggatgcctggggattgctattggagcactgccagtggaatttcacatagagacagacatttttataattggagaagaagggcttatgcaggcccaaaaaggggctcaaattggaatggatttttctaacttattattaatggtcaaaggtgagtggtctcacacagggatggatgaaatctgcttttgtttgatggagtgatgacggcaggacgactgatgaaacggagaaggcaaatcgccccctgagctgtcaataccagttaaggcttcaacacgcagcccaaagctccacgtgttccctggtgggggctgattttggaggcaagggagggacaacatgccactcacagaatgtttcttagagaatgggacaatcccaccccaaggttttcttctccctggtctccatcaatggttggattaaattgcacagctgagaaatccctctaattaagatttctcttggatataatggaaattacacacactgggcaccatggggtctacatgggggacacagagtgtgctgtgattggtattgttggccagtgccaagacatgaccaaggggccctagctcagagccagagtggctcctttcttttctccactgagtctaggctaaggttttagagcctcatgattatttgagaacagaagttgtgcattaggcagaagagtaacccgggggcttgtggttactttcaccaccatcagtcaaagagatgtgaccaattcatgccacctcaggccctcctctgctcttcctccccagcacctatctttgaacttggtgtcttgctgcacatcgtagacagacaagttctctgtgcagctgtgccctagcttatctctgtaatggcatgcaaactacagataactcttcaggggaaaataaagtgataaggattcatatggtagcatctaaggattgtaacagaaatctttccaagattttaggcccatatggcagtccacactccctctcaatgcaacctccattaggtattactttgaagtgaatcctgtcccttggcactgctctggagcagcaggaaatcgtgaatcagagagaatgactctctggtcctagatcaaagttttccaaatgcctctaatatggctcgatgcacaaatcatgctttgcacttgaactttgggcccaaacataagcacctggcatggcacacagtgaagtcccggttccctgagccctagaggcctcatggatcccggctacacagccgcactctgctgggaccagcctcaacaccagcacaggggagtcaagccagttcattttccatgggaataaatgcttaagagctcagtgatcttcttcctcctgtcgtcagtgtacacctacccctgctaggaaagtgtagctcaaccagctctgagcacttggaaggtgagaggacagggagcaagaggttagcaatatatgtgttggctgctttaaagaggaagggaggaagtgcagaaacgagaaccatctcctaccttctatgctaccaaaacatgaaaacaaagttatagttatacttcaagtaaagtcctccagtggaaccacagccttttctgcacttggaccaagacccacagtcccagggtctcaaactggagctttcaggaacttcacttatgaaccgtatcaggaaaacagcaaagtccatggggaagcaaggataagggaggtctcaggaaactggcacatctcagccttgccagctaccagctgcatagccttgacaggttctttaacatctctgagcttgtggatgacaaagaagactgacatcagaggcctgtgctatggactcagggatatcacagaggtttctgacttaaattttttgttggcatttggaatcacaattgctgcaagataccttagttaaacaggggctatactattggaaaaataaaagatattaatggaacagtccttcaaaatagtcatcattctgagaaaaagctctgtaatccactagcccagtgcaggctgacagacatagaaaactcgtttccagaacaaaagacaaaatctggcactggaggaatgaggcacaggttagagagacatagtaaaaagaaaatatatatatatatatatatatatatatatatatatatatatatccatctgcatcaaaactctgttgtattttggaaactatctaagaaactatctaagctcactaaaagcaattcaatgctagagctggcttgttctcgctacaccctttccttcctccctttgatacaattcaatttacagccatttcaaaaatattaacatgtacacttctgcatatctctgtattaatacagtaggtgatatgctgtcactttaatttccatttatatttatttaaaggagagagaggaaagatatcaccagactgtaatatcacagtcctgcatgctgttacgagaagcgtaagttaagaaaatcagaagggaggccttcctaggcacgtacacagagacataggcagctggggcaacatgtcagcacacaggagttcacactgggaagaagacatcagcccgactgactcagaaccacagggcacagcacaagacagggatgataccacagacagcacaaacatggaactacgtgtgttgaggttaaacttacaggcacggaaactggtggagcaatcattaacagagacagaagaaagtgggaaggctctctcaagggtgtccacgttaccacgcacacggcctgacatgcatgagcagtcacgctcagaacgtccgcaatcaaaacaacatgcccgtctcattctcttgtagatggacatcttggctataaccgtgtggttggatgggaggagaggaagagcggcaattaatggcaaggtcacacacagcaaggcagctggaagggagctgaagggatttaacacaggtcttagttcactttaacagtcttgacccagaaaaaaatgcagagtgattgttggtaacagtttggttgtacatcaaaaaagcagcgaaaatataaattgcctttatcgtctcccaaggctgttgcacatgatttttctcccctaggtaaagcggtgaccacaggaaaagggcatggctgaatacactcgggttctcaaatgggaagaagagcaaattatcgacagcaaaaaacgtaaccaacacttttcccctgatatgattaatacaggaggacaaaatatacacactgccaatcaatgaaattagctgcttatttggtataataaatggtttttgcaagatgcaaaaatatctaatatgtaggctttctaatttccatccatttctgggcattaggcagaggctgggacaagctttcatcaaattagatgtgaaacgattacgtgttaatacagtatctaaggatgcctttgctgaacttcccgagagtgagtttatatgatggctacaggaatttaaatttactcttgacagaacaaatatccaaatctgtccatataagaaatgcagctactcaagactaacgctgcagatttgacattaaaggcagttcacaaataagaaatcaccaaaagcatatgagatgttgctctattggaatgcatttagctactcatgggtgtattttctgcttaaagctgagaggatctgaaaatcgcatctgcctttctctccccaccaaatagaaattcaggaagcaatcaggctattggttaatcatattatttcttttttccttatacagaaaatattcgccaaaatcgattaaaactgacaaaacatgaaatagaagaataggttccacgtgaaatatcttaatgcaatttgcatgcagcattgatagctcttctaaagctggtatggtaggttctgcactgcctggggatccaaactgagtggtaacctataaaagttgttggaagtcagcatcgtagtttccaatgcccttcacctttgcctttcaagccaatttatatttcagtacaagagaaggtttttgtacctcattttgatgctacaacaggcaaacatgtttgcttatcacttatcatgaactggcctgcttctctcacgaggtgggagaagaattcacatttattctaagcattactgccaaatggtaaacctaaactgaggaggtgttattccctgcacccacaccttccattttgaaagtcatttcccccactctttctttttctttgtagagaatggttgcactcttattttaaaatatggcttgtggttttgccctctttgaatgttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacgtgttcttttagtgtcctagctagtctgttgttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggaaatattgatttgttatttacacagaagagggaaacaaggatgatttttttgcttcaccgtagataaatcattttgaaaaacaatttttttaatcaaatgctgtagcagaagagaagcccatcaaactctggaatgctatgcttctcattagcaacggtccctggttttcatttccatactgccattttgggtttatgtacaataatagaatctgacacatttgtggagaaagaaagttcttataaatataccgtctttaaggataaggggagggatgatggggatgaaataacttttgaaactatttgttcagaggcaaacagatcagaatgggtgatgtaaacctcctccttgatatgagttcaggaggaaacacagtgacaaaccagtggctctcagggactgtttgcaactgttattgttagccgttctggcgaccatgcattgttctaaaatttcttattgttagcatgcaggaacaggctgaaactggtaatcgaagcagcaaaaaaccatgtgctataagaagattaactgttaattataagcagtcacattccaaagcagcatatgcataaaaaagaaaacatgctattacttgtcattccttcccaatcatttttacactcacaccaaatgcaaaatagaaatctcaaaagacaaacaagtgccaccacacacacacacacacacacacacacacacacacacacaaaatcagcaagaacgatcaatgagaggctcaaagacaagacagaaacagttaaaaactattgagccccacatgttgacaaaccttcatgaatcagaatgtctagatcaaggtgccaccaactgggaaggtggctctttttcgctactgctggcatagtccatttccattgactccctgtcaggtatcttcacctagagacttctgggtccactttcttaaaaggtaagacctcccatctggtggagcgattcatcaggcttgaaggatatgagtactggccaggaagagctctcctctgggccattatacaaatcatgaacaaactctttaactaaaagctgatgaggagttgtctccctggtggtagatgttccagaagaattgaacactctctgtgtaaaattatactcttaagttgtaaaattaaattatatcaaagttaagtcatggacctcctaatttggaaattaccacccctcatctctctcaactctctctggcttcctaacccttcaattttgttacagtgaatcatggatattcagaaccactggtgttttgtttccatttctcagtgactgtttccttttctagagctgatttaggttagaaggttaattttagatatgaagagttccactttaaattcccaaggttaggtctcaaagtgcaactttgaaaatttcaggatttatttcaaacagaagtaagtttcttatctactccctggccacacaaagcatcctctctcctttggtgtttgctaattttctttcttacgtagtcacccattgttcccttcccaaatcccaattctcagacaaggttttccccaggatgtcaatggtaatacaaagtagatctatgaggacatctagtggatcaatgtggaagagcagctagttcatgggcagttggaactagcctttctccaaaaggagcagaaagaggaccctgctgtctctgagaattgaaatatatgcagtgtcatttcaattcaatggcttctcatgatccacagcagatgattaggggtaggggcagtgaaagggtgagaggtcctaggagatgagcctagggtctgcagccacagctggcacaggaggactatttcagtggcagctgactgcgtctcctttttaaagccctgctgcagcttcctgagactgggagcagacaagagtgtgtctctggcaagtgtgaacaccaaagctacttgtcattccatcttagggctcttgaaacttcatgctcaattaactgccccgataggccaacttaactctaggaaagcagaaatacaaggctctagggactcagtttaccctctggttcacatcataaggttcttgttattggaccagggccatggattctatgaggttatgtggttgctaagaatttgaccctgagtctcaccttcctccgaagacctaggtcctggcagtttcacaatttgagaaaaagcttttatgtgcttttcttcaccacagtgaagtggatattcaaccaacatttccatcataacttcatagtactatttacagagacaaaatagaagtatttccctaatggacatcatcaaaactatttgtttactcttgagtgtttaaaacaaaaaggcttctcagaagtgttcttggacaacttttcctctattctcaaaggccatgatcatgagaccagaaacctgttggaaagtggctggtgaagatgcagctcagttactgctctttccttgagtcaaatggataatcagctgtcaaactcaggttctctgctggctggcctttctgagccaagcctggaatggaaggaagaattggattccatcctatcctcagcaccatctgccacctgcatcagcaaccaaattgtcagccaatttccaatgcagaatcttaatttccagggtggattggaagaggcaggaaaaagcagtactggactgaggggcccaggtggagttttccaactgctggggaaaatgttttagatttcaaatggagcaaattcaagggaagactgggatggaagaaaaaaaacatctgccattcaatcaatagatacttttcaggtcacagcctcacttttaaaatcagtcaaatgaaggagggattatttccaagcaagaaacatggagctactcttcatgggctctgcagcaactaacgttactaataaaaatatccacggaagaaaaagtccaccaggatttaaggtgaggcctttgatgtggcactgggaatcagagaatattctttcaagtcctataaatgagaaatgatgtcttcacttagcaaaattcctcccattaccttctggagtaagaagaaaggtcttccaggtggttttccaaaaacagaggagaaagaaaaagctagttaatgtcagcagcacagagcacactgagctagttgattctgcccctaatgactgtattgtggctgaggaaggcagaagtatttggcactagagttgttggttgattgacaccacattttctctccaattctgaaggaccattcaatttagtatgcagctctgcaggtatgaaagtgggccatgccctcaagccatgtttaaagggttctgtcgatgaagaaagccacagagtcgattttggcaagactgtgcattgaattgaagaaggtcatcattgtgttttgtttttaaagtgagcaatctataccctccaaacactgatgactaaccaaaatcagatgatcaacttgcctcttttgctgcaaaggaatgaggggactgaatttgaaacatcttctccaaattccagagccattggactgaactgttccacagattgggtctccttttcagtagagccttacaaacatgaataaagacccaaagctcaatgctggccttaaaagctcctcctcaatggccacatcttgttgagtaaaagggcatcctattccttgagtaagttagaggttcagacacttgtattgacttgttcagacttatacattgctcattgctgaaatggaatgttctcctccagtcagcttttctgccttaaacaggtaaagggatcttccaagatgtctgactaacattcataaagcaactgggtgtgtcctactgagtactgactaaaagaaaaactttgttgtaaagcaagggaacttcatagactgcagataataattaccactgtgcaaatacttgtctccagtaagacaattgagatacttacagtcccaaagttgagtaaccaattaattatctagcaagcacttctcatacagagaagcatgtactgcaataaatacatcactctatggaatatctctactcttatatgtaaaaatatgaatttttacatataagaatgtacatatactctgatacatcatggtacatattgtgtgtgtgtatatatatatatatatatatatgtatcacaacatgggaatatatatgtggcatatgtgtttcctttaggagaggaatccaagctcaataacaaaggagaccaagtataatttatcaaaggcaagcatgacaattaccccagctgatgaagcatctggagttatagtggtaattacttcagcctaatcagtgtcccttaaaagtcctgagacaaggccttcaagagaaacacactgttgtcaaggtcttattttcaaatagaaaaataagacagtgcccgaagctggccagagcccggggactggggtggatggatggagagcaggctccctggggactctctggctccaggctactctgtagactgcattgggggatgaaggagttggggcatgatgtcactgctacatgcaacataaataccaaaagtaaaagggaaactaaaactgtacagaaaattaaaagagtatctcttctagagaaagacagggggaactggactccgggctgctgggaacccgttttactcacaatatatcactaccagtgtgcagttaaaatagagtaggggccgtattccaaggcagcaaagagaaaaaaaataaatcaaagatatgtcaatgatttgaagtcaaagaaaattccttcaaacacatcaaactagacattacttgtccactaggagtccacactttggcaaacttttagagtctgggggaagaaatgtaaatcattagacaaggtttgttatatagaaaaagaaaatgagtaaatagtagaccctgagaacttgctcctcggccagacagctgaatttgactcttttccttgatagagagctatgaagaaatggaaagaaatgcaaacgttaaactatactatcacaggatttccagaaatggaatgtccgcacctgatatttctccggatgagatgacgtgaaatgttgaaggttactgaatgaaagtgaatgaggagctaggggtggaagtgaaaggggaaggctgggttggggaaggagggttaggaagctatgggtaagggccagtgactgtcatgagctctgccctcatgggatctaccattccagggtgaattattaatacctggactaacacgtttggacagatgagtatgtgggtcagctgtcttctccaacttagagagggaaccaagcaatgtctgttcgaaggcatgggggtccccccagtgtgttactaataatcctagtttcttctaattaaagtttctttgcaactaaaacatcttctccaatttcctcacttgcctgacctacatggggaggtttatttttaataattcattttattctaaccaccccctcacctcacacacacatctgcatcctgccctctgttctatggccttttaattagtaggagcaatattcagacaattctgattgttacatagccaaaggcctttgtgagatgaagaagctgaggttgggggaggaggcacagggatgtacagagaaggaagcgaggcccttgttacactggcttggctttgtagaggcaggccttttgcagcaattggtgcagtgcataatgggagattatatacctcactagctccaccaactttaaaggaaatgaagagaagaaaattatttcaaacaattatgggcctctctctccaggatgaagctaaagcctgctgctgtttacctgtctggaaccaaggtggaaaaataccctagaggccaaatccttatttcttatttctagggacaatttagtctgctgtgttccactatggcgtcctatgagggacattccaatgtcagagcaagagtcagagaagttctcacttcatccttccacttccactccttcctcccgagaatgctctccatccagacaccagggacatcttttaaactaagaactaatgatgacatttcctcacttaaaatcttccaaaggcttcctaatataggactaaaacccacacttcttaccacgtcccctgtctccgtctctaatctcatctcatactaccctttccccagtgccactggcctttcttccatccttcaaacaccacaaacttattcctgcctcctgaccttgacctttgctcgtctccctatctggattgggtcttggcctcaacatcacccctgactgaggccttcctgaccttccaagctataaagtagcaccactgcaggattcctcaaccctcaggcagtctcttctctcttcttagcactggctatctctgaatttatttatttacatcatcatggtttgtctccattcaccagagtaaaggattcaggagggcagggactttaccttgttgaccactccatccctgaaaccaaaaatagcagctcatccaaagaagatactcaaaaatatgtgaacggctaatcaatatgtgaatcacagtcttgctatttccttgatactctgtgggatgagggtctggcaaatatcctgtcaggggttattggcctcacctttcctccctttcccaacccctcactacaagcgtttctttacagaagtgttcacctcttgtatttgttgttctctcttatttccctcaaccctcagactgctgtgctccttctgattgaaatgattcaggagatgtctggtcaactcatccgtgctgctgtgtccacaaccaactaagcatggctgggatggactgcctggtgaagaaggtctttggattcatggggtctgtgggggttgaatggggagtgaggttcattctaggccttgttctctcttagatgctcttctcggtaggttgtcagaatcggggaattcttgtcccaagaaattagaggctcttgttttgagatatcaataaatactcatctcgataagagtctgggggaaggggaccagctgtattaagtcagtggaaacagggggaggaaacccatggtcctaagctgccccaccctgaggggatttctgcagaaacttctctagaccaagagtgcaccccaagggaattttccccatgggttgaggaacttctttaccctccagcagagtgatatttatagatgactggttctacattttctgtaccccactctaggagtacaatgaaaaaggtccttccttcagtggcatactttaggaatggtgctcttctgtctggcttctgcttgtgaacaaggattttatggggtactctttcataattgttcttactcatcagacccaagactgcccacattgcctttcccttctgcaaaaaaatgttagagcacccagagaatcaatagaggccttcaggtgtgcccaaatccctgtatgttggctgtgtgactgtcagcaatctcatcctctcaaacttggaagcttagtttcctctttttgtaaaatgggattaataacacccctgccaattacatggggttagggtgagaatcaaagcaatgattataaggagcttttaaaagactaactcaccataggaaggatggcatcattttttgtttgtttttcaagggttgagaacaatttctattaggcaatacagcataattactgcaaaaggcacaaccttctcaaagcaaagaccacttaagtcatggtatctcaggagctcacaattccacgttctggactcactatatctttctcaagaggccccagtggcaaactgctttagaagggacttgagacagaatatgccagaaacaactgagcccagtctagtctaccccaaagagcgatgatgcttgaggtcgacctttggacgatggcaactgaagccctttggcagtggaaagttcttttcttgggggcagtctgaaggtatcacagttgccaactctggcctgtggtattaaaactagcaggaattccaaatggaaagagtcaactcccattttggagaccaagtcctcagatttagtttctctctcaaccctatatactcagggacccccaatccactggaaatcacgatacaaaaacactttgtgctctgtggctttagttctcctccttattatacatcatacttgtctctgttagactggacacatctactgaggcacctctagagtaaagaagcagggactaggcacaggtttcattcctaggtgttgatggtggtgatttttcatcctctgctctaacaaagcaaggacaggtatttatttcatatttctttaaactgctgggtgaaacataaacatactcaagaaaactctcgatgtttagtgtttctctaataagaaaagggaaggaaaaggaatttggggaataggaatgagaaagggaggggacagggagagaaacactacttacgccgtttgcagccacatttttttattcttttgggatctgtgatgtcatcatgacaggccttgcagtaaaaaaatgccctggagaaagagaatggaaaaactgacacgtttcataatccacccaaatgaaatgagtaccacatttcctccacggtggtgccaaattaatgaaacacgccagcattaatttcctttaatcttttgaaaggtttagacatttgcagacggaaatgtttgttgcaagaccatttatttcaaacacaggattctgtgatttgagttagtgctccttttcataaacttccatttacaaagaaactgggaaaaaagttgctgatgtgacacactgtgtctgctcattcgtctttcatttttgagaacagcctttgatgctactcgtggggacatgtgggcaatgagccctgggcccttggtggggaagttaaatacaacaccaaaattcccacagtctggtcaaatatatatttgagggggcagaagtatgtcgtttctcagtcaaataaaaatatcaagcttgtcactctgaaagcaccttttctgggcagccaaagggagacagagttgaggaggtctgcagagagggaaaaacgaaagccacgagtcagtgggttcctctgtcaaaccccctctggagtttcacagcttattttactccaaagctgactggaccaattcccatgctatccagccctgagaacatgcactaaatgatggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgcattagctgtgtcaaagatattctggataagaaaaataagatcattcaagcactatttgaaatcacagtgcctagaacagcacaagaggcctgtgccctttcagtactggggaggtgataaaattcactggaacaaccctacaaccttctggatccaagaactaacaaaatccctggcttgttgcctttaccactcccaacaggaaactgaatgccagctatgaacatggccttttcttgaccagggctgcagaaataaacacaattcttgaccatttgattcttaggttcctttttatgttttcacaggacttgatttataattggcactcattggaaaccaatgttaagacttttggatccacacgaggtcttggagatcctgcagcctaaatctctgggactcagtgtcctcatctgtaaactgaggaggttgtcgtggactgcccagtcattccatgctgggattcagccagccccaggacttctgaatccaagtccaatgcttgctctatcctagcaaattctccactctttctttaaatgccagctgtcatctatgtctcaaaaaaattaaaaaaaaaataaaaagaaatcctagctgactgttgaccctgagtggcaatgtggctaagaacccaatcaatctgccttggcacaggaagaacaggaaagtagaaagcatccaagttggggaaagtaactctgcgtccacttcctttggccattttccctccccctttgttgctcttaacacataatgataataacggtaacaatcatatagctaacatctatagagaacagactacatgtcaggtgtggttctaagtattttataagcattaaacatatttgatcctcaaacaaccctttgaaggaggtatgattattatttctattttacagataaggaaactgaagcacagagaagttaagtgacctgcccaaggccacacagctaaaagtaccaaagctgagattgaattcacatagcctggcaccagagcccaaggtctatactaaagagatgatgacatgataataagcctgaatagacttgtgaaaagataaagtttgattacttcatgaactaaagttggattcttttttaatttaatttttatttttaattgacaaataataattgtattatatgtgtggtatgcaacacattgaaatacatatacaatgtggaatagttgaatcaagctaattaacatatacattatacagataaagaaactgaagcacaccttttgtggtacgaacacttaaaatctactgtcttggctgggtgtggcggctgacgcctgtaatccaacactttgggaggctgatgtggatagatcacgaggccaggagtttgagaccagcctggccaacatggtgaaaccctgtctctactaaaaataaaaaaattagccagtcatggtggcatgcacctgtaatcccagctccttgggaggctgaggcaggagaatcgcttgaatccaggaggtggaggttgcagtgagccgagattgtgccactgcactccagcctgggagcctgggcaatagagcaagacattgtctcaaaaaaaaaaaaaaaaaaatctgtctttgcaattttctggtatataattcatttttaactatagtcaccacattgaacaatagatttcttgaacttattccacctgtctaactgaaatttcatgttttagatggacatctccccaatccctcccaaccccagcccctgttaaccaccattccactttctgcttctatgagtttaacttttgtaggttccacatgtaaataagaacatgcgatgtttgcctggcttatttcactaagcataatgtcctccaaggctaggcaattaaggttaataagtgaaatgaggcaagggtcgggggtgtccatggtgatctggagcaggcagagtatctaagctcagctgacctctgccaagtggcatttctttgcaagaatcattctcttccccacccatctttgcctctgtcatgctcacctcgcaaagcccctcccttactgcacacctgcacctgagcaacggagtttcgctgggaaagaaaacatgctgacctcactttaaacccacaaccatggatttcaggggccttttccactctttgggatctaccccattctcctgttgcttgctttctcacactccaaaacagctctctctcctctcctctccacttgctccagctcaccgtacccctcccacaagcagccttcagctggtgatcttgcttcacccatcatcagaccagctttgtgtcctgcaaggctggcctgtatggtctccttgtcctctggtttcctggcctgcgtgtccagtggaaggagtcagcaggagactagggtgaggggggatgaggtcaccaccttgaccccccgggtgccctcctgtacaggtctatgaaatggcacacgacagcctctctctccagctcctgatagccctccttccccttgaccccacagatctagggtgaaggtggcttcccctttcttgctagctctgcagtgcttggccatcccttgttggttttcctttactatttgcccataactttacagtctcttcataaaactctcctcctttttcccatttaagtttgtcatctgtttcttgccaggacaagaaacagcacccacatttacatattcatctccaattcacacttatccccagaactccagactctaagatccaaccgccttatgatatcactgtgtgtatgtttagtacacatctcctacctaacatagcccagatagaatgcttaacttcctactacccaaaacttgctccttctctagtatccctcatcttggttaagatcaacacaatctaagccctgactctagccttcatccttcattcctcttttttcctcacttctgcccaattcattggggggttctgcacactctcccaaatacagtctgaatgggaacccacctctctccacctccactcaggggtcagtccaagctgccatcatctctcacctaaactatgcaataggcgctgagtctctcacctcttctcctgccccattcctctcattctctacaatgcaggaagaatgaccttttcaaaatatacatcagatcagcttaaagccatcaatgacttccattttataacagatccaacctttctataaagtgctttaggagccagcctctgcctctctctaacctcatctcataccactctccccaaatctattccctagccgcactttccttcttggggtccctatccacaatgaacttcttcccagcccatctcttcttcctatctgatccctgcctgatggattatttcccttcatctcaatctctgctcaaataccaacccctctgagaagctttcacttatacccaacccaaatcagtgacccagttgcattaattcttttaccactaattattttttaaaaaactgtaattctttcctgcctagaatatgagccccacgagagttgggacttctccccattgttcatttttcaccactgtttccctggtgccttgtatagagccttctaaatgtaaacgacttatacacatttgatgggcgaatgaatgagtgagtttgagactgcttcccggtattgttgggtctgccaatttttcaggagaaatgagtaataaggatttttatataaaagctcgtaacttttttcaccttggcaactcatttgtattttaaaattgtgactcaaaaggatcatatgtgcaagccaaactgagtcactgagccaccgttttgtgactcctatattaaagtctatgttccaacgttattttaaaaggaaaatatttggtggcaaggaggaaagagcaagtacccaaatgcccatcctcaagtgaccttcttaagactgcagtgggatggtttcactcctcatttactaaaacactgcatctgaaggtttctacaagctagaattcattaacttcttttgttgcttttttgcagtggagggtgcaaactcgatacgagatcatcataatctacttttccatttttacaaagcttgtttagtttcattcaaatctccaatgtcctttctgtggttttttgcagtcttcatctatttgagatcccctaactgacagcatttgctttgacacatcacatgccatggaaaattacagcctggtgttgtagctgattgtgtcagcatgtatttgtgaataccataaagcactgaaatgagacatattgcactccctaatataggaggtaatttgttttttggacggcctgatatttgtgacattcattagtgagagatgcaataggaaatagaattacacaaatgggagtttcatgttatatttgctatctgggaggtatacgtgatatatggttctcctgtgctccccagcctcctgtacttggtgctgagatgctgtttcaagcttttgtgtctcacagtctggacaagggcacaagcttcttctccaggagacctgattggagcacagggagagggaaggttcagtcccattaatcctaatttcccttctcaggtgtacccagttctcaggatactcttgaacaaccgggagattctgtgaactgagtagggaggtatttttcccccacaactcaatcatggcaatctttccccaatttgcagaaataaatttaagttattagagcactcagtttaagaattctttttccttccaacagcccatgttttctttttcccaaaagcttctgtagccagtatggcttagtttgctagagtggatggggaggaagaggaccctaagtatccacggtcacatgtcatcgttctgtgctcagcgtatcaggcttaacctaggcaaataattaagagtgcaagctccaacttcctggctttattcctcactagcagtatggctttgggcaagttagttagccaagttgtgcctcagtttcctcatatgtaaagtgggaaagagtaatgctacctatctcatggggttgcgtgagagtttaacaagttttagatacagagaacctagtacctagaatagtgctggggtgtaataaaccctcctctgtaagaatgtggtagtattattaaatttggtagaaagagagtggattttagaaaaggaaagaccagttccactctgggctccaccacttacttatgtgcctcatggccttggacaaatcacttatctcgattttacagatgaggaaaccaaagctctgagtgtttgagaagacttaccttccagggttattttgaagagcagcaataaagaatgtagcacacctagaacaggcctggctttgactaggaactcattcaatgaagacaataggcttatataactaatgatagaccttcacaattaataatgtacttaaaatattttatgcaatattactgttgagctgaatgacctgtctgaacatttgcatcacattttctgctagtaaatttctccaagttcataagatagaatcaaatacaataatattccatgttgtgctgcaaagggccctgtgaattcctaggctgcttaaacaggtttaaggatacgaataaaaatgtcatgaaacatgtaggccagtgaaatcctgtgctgcacttacagtggcttaacaattgaagctgacaacttcagccacttacctaggaggccacaaatagaaatagagccagtttcatattccatctgaaattaatcccaaccttttgaaattctatttggcagggagagtagtagaaaactgataattctcaagtaaatttcccagataatattaagtaaagagcactagataaggagccagttgtcttgttatgttgttctgaatcatcaggaatcaggatgacctcgagcagtcattcagctctctgagcccccattttctccctcacaaaataaatgagcaggtaactaggcttcctagttctaaaattttattattctcattcaaagatgtggaattcactacatgaactggagtccgtggaagtttttcttacaccagttgatggccatagacatgttaaggagttttggggttatggaagcctgcctacttccgtgggtcaaggtgtctacagccgggccagaaagaaagccagttgaaaataaactcttaccttttaacttctttggcatcacttgcgatgaaaaatcctaaagtaccttcttggatcttaagatggtttccaggattaattaatatactgctcagtgaacaaaaacaaacagagaagatacatttgtgaggtcatgttctgaataaaaccttgaaggctacaccatactgttgtgtttatagggggcccactagtctaaagctttccccaaagattttgtccagagtccaatgtccactgccccatacatttagttggataatgccatcattaagcactactgcttacttcccaggctggcatgctcccagttgaggaaatcaaagcaaatcaaggtattagggcctgggtttatataatggagcagtctagctgccatcatgggcacatgatttgaagcaaagtccatcagaataaattccttttgaaactgctattggtggtcaacacggaagcattattggcctgatgaagctattgctacaacaattttccattaaatgacagagcattaatgggacccctatagatatacataaacatcatgtacacacaccacatattaccgcagggaatggtacaagacacccgtaaccaatgcggaagcaagctgaacgtcttcatgacattgataaggacatggaaattgattccatgtacagcctttataggaagaattggatttacccaaacagtttttttttttaagtcagcagttggatatacttaacaattccagtctgctgtttataaaaacgtacagggtgtttgaataagatgtgtgtctagcatgtcctaattgaggcaaattgagaaaacaaatgcaaacctccccttaaaaaaacttgccctgcagagaagtgggaacctaaatatacattgtcctatttcaaagtggcataaatagattagcggaccaagttgtgtttggactgacagaagagataaatgtatcctaatctaataaatggatgaaacaaacaagtttaattttctgcagatcaaaagcagaatacaagattgtctgatgcagagactgagaaaagacttcaggcttaatggatactgaattcagggattctgaataaaacaacagatacaacagaggtattccttgttctgaaaagatgttgcttaataaggtaatagatatttggaatcagtctaaaggaagttctcagctgccccaaacaatcaaaatatagaggatggtaattaacacataatcttttttcctactgataaaccattccagagaagtgttgtggtcatgaagtgatacgtctgtagtcatacaggaaggacccaggtgaacctttgttcacctggttgggagacctccgagcagatcattattgcaaaataattttttgtggtcacaagaacatctaccattacttataacaatacctgacaggaggaaactgtacttgtgtcatgactattattaacactcaataataccaaaaggctatgaagatttaactgttctgccctacaaccacaggcagcagtgagattcctcccaaatcagacagcagcagtccacactaatagcacggcctgcactgagcagcggctctccataagcacctcctaatgacccctccgccaactcttcacatgggtataacaagccctctgacttcatgcaatcacgagggtgaagtgttagagctcatacagtttagatgaatttatctttcaaagccaattcagtatgatgttttagaaaggcaggattataaattttgcacatttttttaacctcctttcctgcaaggcagtttttacatgccctggctctgcaatcagaatttgggtccaaattccaacactaccacttaatagctgtttgactttgggccagttactaaatatccctagaactcaactttcttacctacaagaggtggataatggtaacaataatctttagagaattaagagagatgatgtatagaaggctcaatgcatgtgggttattgttcctttttttaattcttgcaaaaaaaaatccaaagtgtatttcattttcaacaaagttatcacagattttctctagctgaccccatggaatataatacagtcttcttatcaaaataccttgcccattaatgagatgaaattatagggtaaagaactgtacgctacagaataatgtataaggacatacacaaaaaattccatgcactggctttgcaaatgcaggtaagcctcacacttctcatctgtaaaatgggtcctggctttgcaaatgcaggtaagcctcacacttctcatctgtaaaatgggtgaataatcgctagcttacaatgcctctaagagagttaaagtatgtactatgtgctacatgactgacacatagaaggtcttaaattcttagttgctactctcagtgagctaggtgattataaaactgagaggtaaaaaaatcctcacagcaccatcaccctccactttgtccctgctgctaataaatgacccaggaggtgccctattggcattgaaagacttttccactgactgcaaggaaatccaaagcattttatccctgcacaatatctggtgatgggctaatttagactgacttttgtctgcacagtgaagtatcctgtgttccttaaatctatggctgattgtgtaaggaatcgaaagcatctctaattacctcacagatcatgtggattccaggatgccctcttattccctgtgaacaggggtgagggggtttaaatcatccccatgtgaggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccgtcttcttcaaaatataaaaagacaaggattctggatagtgataaccttctcccccttttgcctactatctttagaattcgttattgaccttctaataggaacacataaatttttccaaggatctctgatctctttaggagagtatccaatgttaagtttgttttgttctactgactgccaaaagtctctctctctgtgcgccactctgaatcagttctctagctccaactttatataattcactagtttatcagagataaacttcaacatgtgtcatgtgaagaatcaggaaaatctctaagagaaaaagcccatatatccattaacagaattccaacaaggacatgttggcagaggtggactttccctcatttcaaggaacatataaattatcctttcttctttgaccttactggtttcaacagaaaacatccagtgacagctggaagcacggggctggtgtggtcccttgctgtctctgtttcttttgctctcagactagttttaagtctcgacttattctttgtttactcacctcctacatggagcaaatacgtattttctgtaaggaacccacagttgagtagaggggtacaaaacatgatcacattctatttacctttgagtttcctggagtagcaggcttagagccttgcacgcaacaggcacatttcaactatttgttgaatgaataaaaaaaataagtttttaaagcctcagttccataagttttcctttttttcacaaataagtggaaaggaggtcacagttttctttcaaagaacaagctacaattctcatcagtcaggccgattaaaggagtgaccacacctctgctagggctaggggattggccaatgatctagcaatctctcagatgtgttaagtatgaatatgtaaatatcccaatatgtaaacagcctgccacttgcaaagttggggcaattgatttcaacattgaaagcaaaacttcaaagagaaatatgggttcctagacataaaacacatctacgtgcaattggctagcggggctcagtcccgcagggaaatgcctctatcaggtccctccatgagaggagcaccgcgtctcaagttgtatcacatttcattgggtatctctcgctaaacactggtcaggttggaagactgcagcttgatggaggaaagtaatgcattcctttctccaccacttgtgcataactgggggacatctagttttgtcttcaatcattgtaaactttacttgtttcctgtttctgaagacaacctatgattcgtaattcaagtgaaacagatattgtttaaggaaacttctatccattatgggtaaatatgatacatatatatttctctcctctccctttcatttttggtaggtgtaatgtaccattcctcaggcaatttttaaaaaatagcatgacttatatgagaacatactttgtgcttgataacgtagtaattatatttgtgtctagcaagctaatgggacttcattaactaaagcaagcaaataagaaccatttagggtttccattcatgctatgcccagatgaatcatgccattgagaagaggcttctttgatcacacaagttcatatacaatgactctcagttggaactttgtttgaaccaatccgtgtcccctctcagagagtatgactgcatttgtagtttacaggctatgtgcaggcacagttcagagaaaccccacatctcaaatcttatcacctttctggaacttttcattttttctgggctttcaaatacatgctgctgctggagtcccacacaactagacacacacacttttactttaggataccattggagacacagttgtgtatttcatatgtcaatatacttaagcccagttcacttacacacagacagcatgataaagattgctcccagttggtcagactcaaatgactgccactgtggtccaccagagatactggtgaggacttactcagcctgcatccatctcagtaactttagaaatggcattttcaaatatatttcgtacatacaaaaaaatattagccatatgggatggggaacagagaggtgatctagaaaggataatgctggatatttggttctgggagcaagccaaatcattttctggtatacttaggacaagtcatgcctacatcacaacatgccttcaccacaagataaaaggactcaaaggccaaaagccaacagcagaggtgcaaccactgtggacctttaagatgcaaagtgttgcagtaacttcttgcagttggatcatatcaataataccaaactgacaggaagccacctctatttatacacatgtactcaaaaaaacaacagaagaatcagattttggaaaaagatacagacaaatacacacgcacagacacacacacacacacaattacaaacacaaacacatgacagtgattacaatcacagagaaaagtaacttgaaaagatgaacaagtaggcatctcaacagtatgttttcaacaatattgtcttagataacacattattgaaaagctatcctggaactattaacccaaaagtttttttttaaatgccattgatgatgatttagtcatgcttcatgcaatgtaaaacagcagcaaaacagggtgaaatcacatggtgaaaattgagaaacttcatattaagaaatatgcccaaacacactaggaaaaaaaagccatgagtctgtctcaataaacagtactaactctgtaaatcaagtgtgataatctggcaatttaatagcagtgttctaagactatactgagcactgcccaagaaataaaatattcaaaatgttatcaccaaaataaatgtaaggaaaaatagaagtgtaagggcttggtctctgttttgtggataaaaggacaggaattctgctctatagacaagaaactcgacacagggaggaggaggtcactgggaatgtggaagtggtatgtagacaaaatggcactagagtgcaatggacatcaagacacgtcaggacaatacagaaacagacacaaagggctggagagaagcatcctcctgttcaactttaatagtatttgttcccattattggtgccatgactgaaaacaggagtgtgcctttcctttcttaggtttcctgcaaagaagttagtgcgtcatccaaaagaaccaacaaatcaaacaggaacagaaataggctacttccaatttatgtactctagttggagaggggtgtgtgtgtatatatatatatatatatatatatatatatatatatatacacacacacatatataatatagatacaccagacaagggaatgagattatatatacatatatataatctctctcttcttgaattcttggcaaatggttagtcctgtggttaggagtgaagatagagggtggaggttggaagaaaagttaacgaagagtgcataccgctttcggcttctgcaaaacgacaagaaaagaatttaaaatcaaacaatttgataataaatcgactgacaccagaaggaaagaaggaataaaacctttgtttcaaatcacttgaaggatgcatgtgaaaacaaggttttttggcaaagcatgaaaacagtatcatggggtgaaaccaacaacaaaggcagttaaacacaggttaaagaaggtgggaaggagaaacaggtcctttgaattttcacacccagtcagttagaaaatgtgagagggaaagaagtgggacatgtttaaataaagaaaaacattaaaattattatctcagggaagattttaaaaaatgtgtgttttcacgtggatattgtgtttgataagtcctgtgttttctcagaggcatgatccacattccctcaaacacacctttttccacaagaaccaatgtgcttccacactgagaccaagccacatttgagaattaaagctggcaactgcacaaagaaagcccaaacaaagccaaacaagtcctttttgcccttttctgaagaaaaaaaaaatatatatatatatatatatactaaaaactatatctacaaatatggctttgttgaaaacatctcagaattgtgactcaattgaagggcctatccaagaaaagtttcatcttcagggagtgctctgagttagttttcttagaatagtgacattgagttcacaatgaaccattaacagcctttcgctctttttctctccttggaaccaaaaggcaacaagtgaaagacaactgctcaaggttcagggtgcaatctcctgcagtcagattattccagaatggtcgaaaaacactatgcagcatcagcatcacccacatcatgacatttttttttgaaagatgcacaaaagtaaatagagaacactgagttacacaaagatttgcgatttcgcaacacggggaatatcatttgcaaaaatccaggatacatacagttcccctacacaggtacaagtgagtattggcaaaaacatgggtaaacagtaaccccagaaaattccacctcatctgctgaacaactaataatcaggactgtcagtttttgcaaacaatattcttcactttgccaacatgaaaaagaaaatatttatctatctacatatttgttaactgctacagccatgttctacatatggccaccaaatctaccatttttttcttccttttggttgatttgggttttcaaaatagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaaggtgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccctcatcagtctgatttgcacataattaagtgtaaaataaataaataaagagagctcctgcctctgagctccactctcctggctcatttacatgaagctgatattctgccacctggattttggttgcaccgggagaagcacatatggtacacaataggctgcttgtaatttggctatcaagagagttggtgtctcccctcacagctctaccccaaggctgctgtaaaggaggccagagtccacctgcttttttgctcacagcagtaaaaaggggttttaagttctggtttaatacttagaaggtgaaaagtccaggtcggcatgatcaggtggagatattttgaggactcatccctcttccctggagaaacactctctgaatgcccagcagggctttgggtgccaggctggtctggcatagaagctgcagtgtctgatggggcatgcctcgaaatgtgctctagggtcagagaggttttacatctggttccatgcagataaataatgcacaagaaagcagaagtgaaccgaccgttctcagaacgcactctcaccatcaaaagtgtcagctggctgctgggtcaccgcaaacttaccggctctctcggttggcagacttgtactcaatggctatcattaggagcttgagcttcacaaaacacagcctgcaatgagatggagaagcctcccaatcagttcttctgaatgaccagagccacataacacacactattacgatctttcggtctcctaatgcagtcattaccgaggggatcctcattccaccggcactgtgccaaagggagggggtggaagcaacacctccccatcttccctattaaacctgatttcttgcaagtgataaggtgctggatgctcaaagtgcaaattgcactcaggtctggctgtctagacacagagcccaagcaggaatttgtgcctggggatttactctgggccagattcattagttactcggtcgggtagtaaaatgttaactacagggggagggaaagatttggaccagctggacctgttatttggattccgtttcggtcttttgtacaaatggctcatattgttgttccgagcagacccctgtgtgcttgcaatgatggtaataatacttggcctctgtgtaagtgcccagcacatgacgatggcattgtcactcctggctccatccaagctgtctcacctcatctgcttggtgctctcgactgcagagcagactgctttgaggctggcttgttcctgtttccatcccttcccttgtgcgttccccactctcgatcccttcttctctcttcccaacccatcctcacaggccacgtcaactctaatcttgcaagcagtgggtcttctccagctactgctaccctgtgattttctattctcaaaactctcccagcaccttgtctgtaaccaaatcactgagcctttagtcaattttacactggctgtggtcgctccctattgtttcatgtgtctgaactttgtctccttaaccagagcaacttccttaagagtcctggacttgtttggaattctccatagtgcatagtgaatagacccaccgatacagagaagctaaacaaacaaatggtttccacttactgggtttcaagtctaagaaaataacaaaaggtgcagtaaaatgtttatgcttaaagattttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatagaacaaatatataaaaatacatgaatatgtaaatggcacaatacagttagatgaacctatacacttacatacttacagaataaaagctcacataaacaaaataattacatacatgatgtatgacaagtgtctacaattagcattaccattttgaataatagaatattgattaactgatagactgaacaatgagttgatgcttatttatttagctccagcattgtaagggggataagatactgggtcacagtgtggggaaggcttccttgtgggtcaatttaatcccctcaatatccctaagaggaagctattaccccaattattcagacttctattgatagctccattttacacgtgatgaaaccaaggatcagaaagtccatgtaacatgcctaaggtctctagctaatacctggcaggataccctacatcttgatctccagtgaagcctattttgtattgggagagacagacaataagaaaatatacaagtgaataaacaataaattcctagatgatgacaagttctatgttgaaaataaaacaacctaagaatataaagagtaactcagaaggggtatatcatctgtgatggttcaggaggaccattctgaggatgcagggagcacaacagcatgatgagaagatatggggaaagagctttctaggaagtagaaacagcaagcacagaggccctgaggcagggaagagctctgagtgtttgaggatcagcaataaattcagtaagactgcagctgagtgagcaaagtcaagcgtgacagtgattaggtcaggaaatgaggggggagcaagatcatgaggtctttgctttccagagcaaggagtctacagcttattataagtggaattgggggattttagttggtttaaaagagaaaagtgacataatcagatgtgctggatagggggatgtgttgctttcaaggaaagtgctgctgaaggcctcatgctctccagggagtgaaaccaattgctcattcctacatgtgaggttgtggtccacagcactgccttcagcagacagtcagatgtcaaaggaccacttctatccaggcatatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaaccactttctaatgtaaatagtagctaaatacaaaaacatcagggagaaggctgatcttaaacttagtatggatcgtgcaaaggttaatttgctaatatcctatgagcaatgaccagtccactttgggactctggtagttcatgggatcaaagatcttcattgcttttataaacctaatcccgctggtaagaagggaagtaacagttcgtagtaatggtgaattatgtcttcctagctactacagtaccatctaccaactggatataaaaagaaaagagtttcctctacaagaaagtcctaaggtctatgtggccttgtattcattccttaaccttataggggatggacccgcagatctgagtcctcttccagttttaaatccataacttcaaaacattcaaatccatacccaagctgattctacaatgccttatagaagccccttttaaaaagtcctttgacccaaaacaagctgtggcccactggccaaaggaaaggagagggatagaatgatgtgaacagagagaacataggcaagccgtgccacaacacagattttcagactcaagcccttcaagattggctgatcttgcccttcctatgcagataacaaactgagcccaaacagaggagagcaactaggtcaaggtcaattgacttttatgtaaaaagccaaaagtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacatagaaactggcttttcagctttccttgcaaaatcagatagggccacattggcaccacattccacatgctaaaagggagtgcagctgtgaagcacttatccctctggatgggatgtttgttctccaatgtgccacagttcccaccactctctattgtctcagatggcctcactcttcattctttcttgctaactgcctgaaccctataggtatctaagtttttaatccctactataataggtatcctctagatattgcaaaatacaaatcaagtataatacaccatgatttacactggaagcaagagctatggctccctctgtgagtgttcaaatcacacgtttctgttagatcctgccacagagagttggccaatgtcacaatcctgggcttaaggactgcatcctgttgcagagatgcagcctctgttggaggtgtccattggggaagagcagagcaaggtgaatgaacaggggagctggtgtggtaatcacttgtttgcttatctctcccctctagactgagtttttcctgtacaggatgcatgctttgcctcactggcattttgcaaagttcaaagagtaagccttcagtaaagtctggataaataaatgcatgtatgaatggggagtagaatctcatgactggctggagggatggagaaaagataaagtggcaaactaggaaagtctatgcagagaaagcttggaagtgagtatagaatcatgaaacaagctgcttcttagcttgtcttatttgttagaagcagacagatgggaaaggaaggatacagaaggaaataaaagtagtgatatgctctgggaatctaatttttgccttcaatccacaatgccaagatgcaagtccaattctaagatacaacaatttgtccttgggaccttctagagaccctcttatacccttatgtaccccttacactcccaagaatatatatactttcagtatacccagaactgatgttctctggttaaacatttacttgcatcactcaacaccattttttggtaaagaagaatgagcattagccatctaatccttattctaattctgcctttactcaacttacagtgtttcaacatatacagaattggtgtgaaatcaggaagcagggtgaggtgaggtaaggggaaaaaaggaagtaagaaagccttcacaatgtgataaatgggataaaatcagccataagctagcaataatttaattattggtttctaaaataaaatgccccagtatgtccaacgcaggaagttgttgctggttgcaaaaataattacaggggaatagaaatgacttcttttttcaagaaaaaaaatgccacttgtcacaaaaaggtcttaagccagcaatctgcaataaaactgttataataacaagttagattgctttcttgataattattaggtaaaggtctaccaaatttgacaacgacattatacaaagcccaaccccccttttttttttttactgccaacatcatctgttaactacagtagtttcaacccagatgttcctgaacaaaggctcttaagaattagagtccaactgtttctgcctacccagagggaaatacattgttcctgccattaaatcagccccctttactggaaacattacttgctggtgttaattaaacatggaaacctgtcatagagtttgcaccttcaggaagaaaatacaaagaggaggtttggggctgttgaagaggactcaccccacaagtcaggtgagggaggatgaaagaagcaactgtcatcattccccctgaacccaaccccacccaaagcaccagcccctcttcagctatccagagggcccctgggaatgtcaggttggcacatgcaattgaagtagatacggatacaaacactgcacattgggaaacaaggtcttctggatcgaggggctggaatggaaaagattcacattcaggagctttaatttaaaatgacagccgctagaaatcgaaatatccaggtaaagaaactttgaaacatccggatttccaagactcagcaccaagaaaagagaagtgatttaaaatgttcatggaaatgttaagactctttttctctatgaagctttgataggagtggagtgggaaggtttcagaatatccccaccctctctcccactctcttattctctccttctctctctctctttcacacacacacacaaacacactcacacacacacaatctccactagcacacctaagacactagaatttataaatacattacttgatacagacaattaacttttgcctaaagtgtgaacaactgcatttttagagagccttgctattattattaatgagaaacataatatgaaagaaaaaaccatgtgtttgctacaagaacccagtgttgagtcaaagcccaagcgtccaccccatttccaacaggactccttccctgacccttctgtagagaattctggacccaccactgcctcagtagcctgttattgaggatttcaatagactttagggtcaacggtttattcactagctcatagaaggtcacctcttgggtctctgtagtagaaataaccaccaatactgtattcacatctctattcatatatgttcaaccctaattacaatactccccaatcaagtggatgaatagagccagttctgtgaggggaaaatattttttaaaaaatgagatctgccaggtgcggtggctcacgcctgtaatcccagcactttgggaggccaaggtgggtggatcgcctgagctcaggagttcaagaccacccagggcaacatggtgaaaccccgtatctactaaaaatacaaaaaaattaaccggttgtggtggcacacgtctctagtcccagctacttgggaggctgaggcaggagaatctcttgagccccagaggacaaggttgccgtgagctaagatcacaccactgcactcgagcttgggctacagagtgagactccatctcaaaaaaaaaaaaaaaaaaagagagagatctgagcctctccataaattcacttaaaatgctcatttttgcagccaggctaaagaaatctatcatataacaattgggtctgcctggtttctgctccatgttcaaatttggatgtctttctccaaaaactaatgatttcacagaactgaagttaaactagctacagttttcactgggcaagaggcccagctttcgccgggcggtcttaaattttaaatttccccaagcggcttctttttaaagatctgtctgtgcaaaataacacaggttgagagcatgattttctgaatttaggaggggagcactgaatgcagggaggtagaggagggaaaagagaatccccctgcactcttaaaccagcacagtagcatccatacttgcccctgggcttggggacagaactcctgcccttcagcacagctgaggaagatctgattggagttccccaagttccccaggcattaaatactccacatcaaacctgaattttaactgctccatcagctgcagagggacagagagagacacataccatattttaaatacatcttttgtcctaatcccctctgagctgtaaaacctgatacaattaagcttttatattttgcaaatgatgaatgactgactaataggttcccggtgagattcagaacctagaacacagtgttcttgaggcagcccaactgctgaacccatggtttcctgcagctcctccttgtccagcccctcccctcccctctgccctccctgggggtaggggagtgcaccctcgctttcgcaagtgctcaccaaaaacactgttatcagtttcccccaaaaaaatcacaagtcaaaataaatctgatgcatctctttgtctcatctaaagaggaaagcaatttgctgtaactggaaaatctcggagacctaggtgttgagagagctccctatggtaccaggtggcgcagcctccagattccctaccacttagaatgtcctcttccttctttatcccccatctgaatcaaaactcccgacaagacacagctcaaatgtcatctcttccaggaagaacccccatgtccccccagcctacagggagatgtccctataactctcagcatctctattccagctgtgtgcatctaccacagcacttatcagtgggtgtctagatctctctgacgatgggtactatttcccttagccagacagtaaactctggaggcagccaccctagggaaactgaatattttacttggcatttgttggcatttgtaagtattgctattaatcttttcatgcacatatatttgatcaaatctagtagcagtttcctctagaagtggcaccaagcttggcacaatggtgcacatatcccaattcattaaatatctgattaatcggtgattaaccgataagagaatttcctaaaggttaaaagtaaatataacttggatacacatatagctcgcaatgtgtttctttctttctaagtgcttctattatattcaatgagaaagataaaggtagaaggaaaaggagaggagggagaggggaaaagacattaacccgtactgacagataagtcatagcactcctatttcagagaaggagattggagtaagcatctgtgatggttaatattgagtgtcaacttgattggactgaaggatacaaagtattgttcctgggtgtatctgtgagggtgttaccaaaggagattaacatttgagtctgtggactgggagaagtagatccaccctcactctggatgggcacaatctaatcagcggccagcatggctaggataatgcaggcagaagaaagtggaaggactagacttgtgaagtcttccagccttcatctttctcctgcgctggatgcttcctgcccttgaacatcacactccaagttcctcagcttttggactcttggacttacaccagtgatttgccaggggctcttgggcctttggccacagactgaaggctacactgagaatctcttggcttgaaattgatagagatagctttcggggtggcaggaccttctgcccccactgcctcttttgctctccttcctgttctcttgggaaacaatctcaaatttcacccctacatcctgctcccatatcttttcatagaatgactcccctagcttctgagaaaactccaagctctcccaatcccaccctgcaagggagcattttgccagcctagagaaaaagcacatttatttctttccatgctttaagatgttattggctgcatattgttttagcgcagcgcataattacagaaactgctctgaaaatctgtatattttatctgtgctttatgatacccagaatattccccaattctttttcttcttcgtgaaccagcttaaaatatattttggcatcctttatgtcattttgaaattgaatagccaattcttactgtaatgaaaatacttatgtgccagcccagtgatatacaacactacactctaattacggctgtgctttaattaacctgaattgaagagtgttatcattaaactgctggtaactttgagttatggcttttctttaatttaaagtagaaaacacagataattaagcctccagataatcaaatgcttgaggagagcttcaatgttttgggatgttcctaaatctcattaaatgtccttcttttattgatcatttctacctctgctgtatcattgtattaaacgaataatagcactaagttgtacacattctcactcacatcagaagtggaatatatatatattccagaaactttactgagcaaatactaaattatctgacaacaatttgtctccttcttgggacatgttctaaatacaaaaatcaatcaaagggaatattcacagagccactagtgccagctcttgagctggctgaaggccagtgaagttccacaccacccagtgggtcagggttggcaaactcacacaaccacagggccaggcctgggatttatgtgcaaatctggcctggtttaagatatcagggaggagtaactacatgactatactaacccctttgctacatcaaactggagccagttagcattctgaggaaatgcaggtcttgcattgtcacattagattttctaaagaatccagaaatctagtttttacgtgacatactactatttggaaatatcagcaactagttgatatctacgtgagtcaaacatacctagtgactatcccagttagagcctgtagggggagcagtcctgacccttcaagttacccataagaggaacggactcagttcccaagagcagagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccagggagggggagatcccctgggacagcctcagtgttccaggacccaatgcctctgaatgcttaactcctctcagtggcaggaagagaaatagctctcaaagaaaggcacacatgggagtcacaatagggcatccattttcagaaaataactccttccgaatcaattacctattcacttttccagtccatttagcattaaaactttcgcttagagacagggtgagaaatttcagtaaacagccaaaccattttggattgcttagggtctgggcccagggactgacagagtgcacctgctgtgttcagtgacaggaggctccaggtaaacacgaagccaccaagcgctccgcctccctccctcctgcatacagaaagaaaaccgtgatacagaggaggccaagggcacccaggactgtcccctcctttgtggtaaagcctgatcagttttgtttcgatgtcttcagacctctcttttggtttgtatgtaggcaggaagtgcaagcaaatggcttttcttcctcagcccagtgagctcccagatacccctgtttcttcccagtgagaagaatccttgtcaaatcctttgctaaggtgtcaggagaataggcttaatgtttcaccaacctcagggagtttgtgttttcagagggcacaaagaccccgttcatcttaaactcaacatctgagattttttattattattattttagagatacaatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcaaacatgaggattctaagtgaggaatctgaggcactgtcatgcctcacggcagacacctggagctcttgaggtcatcccccataggtgaccatctattctacctgcagtggccatggcgggtggctttgatccatcctgctgagccagtggaaagagaagctaagacttgttattattataacatggcagttgtctatgtgggggctcaaggcctccttctgtatatttggttccacatttcctcagcaaagggtgaaaacactttgaatggctttatttcagtagcttctctgttgtctctatgatcagacttgatgggaagacagattaaaattcctttcattgaggggctggcaagatttgttttgccctcttagaatcagacaggcaggggtttatgccactcttcataaatgtgtctacatcacagaaggcatgcaggataactgtagttcataagttagcataaatgatgaattcaagtccaagactctcaggcctgtcaagaaaagtggggccagtggaaattccccaggcagaggccatgtaatgacccaccctcctattcatcacatggggccgagcacacgggataccctcggcaattgtcaagtgctccaactgtacccagcagaggtgggaggcttccttgcaaggggcacattcaatatccctgaaagccaaagagcatccagttaaaggtcacttactcacaaacagtagggaaggacagacccacgaaggcactggagagatattctgtgtacatttcatttgagactccttccaagtagtatttctgccatgtgtcttcctcaatctaaaggaaaggaacacatgcggagagtttaaaatatgacggtgggctgtaaaagggaaacctgagttacactcttaggcaaacaaatgaatgcactggttagataatggtgaccttttcagcaatcaggaacacggcctctgcacccatataaagccttcaataaccctaaactcataaagtgtgtgccctctaaaacacttttttaacctgtgtgatttctttcctttttcttttttctttttctttttttttttttttttttttttgagacagggtcttactgttgcctgggctggagtgcagtgggtcatagctcactgaagccttggacacctgcactgaagcaatcctcctgcctcagcctctggagtagctgggactataggtgtgcatcaccacacctggcaatttttttttttttaagagacagagtcttgctatgttgcccaggcttgtcttgaactcccggcctcaagtgatcctcctgctgctgcctctcaaagtcctgggattacaggtgtgagccaccgtgcacagtctttaatctgtatgacttctaatggtgcggagacatgggcactcacccacattagtgggcaaggaaattgatacaactgttttgaagagcaattttgcaattattatcaaaatttgtaaaagtacacagtcttttacactacaattccatttgaagtattcatagcaaagaaacaggaaaacagaggtaaaaaaatatacaagaacatcctttctattcatgaaaaatgggaaataaccgtaaatggcacacatacaatggaatactaagaagcaattaaaaattataatgaaaatgtatacctgttcatacagaaattctgtaaaaaggcacattataaaatagtgtacataatctgatcctatttttttagatggcctatagttatctgaatgtttgtaaagccataaaaagaatttaggaagctttatatcaaaacactaacagttgttacctctgagtggtagaatgatactttttttcctctatagattcctgtattgtctgaaggcttttataataagcatgtatatattataatgaaacagtatatttctactttgcacaaaatgacagatttttctgaccccccaaggaatatcacaaaaggtaaaatgttagtttcagagatgtcttgctccaaatttcaaaaggagtatcacaaaagtaaaatgtagtttcagagaggtcttgctccaaatttcattaaaatatgcattttttctaagtagtcaagtttagctggttttcccagcaaccctcttcatgctaggcatctctgaaaggatttcacaatgtagtgaatcttcttttttgtttttttgagacagtcttgctctgtcacccaggctggagtacagtggtgggatctcagctcactgcaatctctgccccctgggttcaagagattctattgcctcagcctcctgagtagctggaattgcaggtgtgcaccaccatgcctggctaattctttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctaattcttgtatttttggtagagacagggtttcaccatgttggccagactgatctcaaactcctgacctcaagtgatctgcctgcctcggcctcccaaaatgctcccaaaatacaggcatgagccactgctaccggcttacaatggagtcagtctttagaaactggtgaattacaaggagaacgttgagccgctatgggagcttagggatctcacaggcctccctgagggaaggagggcaagctgtgtgtctttggctgcagcctctcaggcttcccttccagtgggggcatgggtaagaggaagatgagaggaagccaccccgccaacaggaagtggctctttagaacggcttgtgcttatcttgtattaaaaggcatcttgctggcagccagtcagtcagttcactgggagaaatgcaacatgtggaccagaaggagagctaggaacagtgggcaagggcacacctaccatctacttggtgacactccagcatacaaaagccagaaaaaatttagaaataaactgaaggctccctggctctgtgctctttgtctgcttttagctcagtctgggcaattagattatgtaggttaacctcattagtttgagctgcttccagcctactcccacaggttagacattagctaggcagtgctgctgggtatgagcagtttatctacaaattggccttccccagagtggggtctttaaaaaaaaaagtcactcaaccaattctattgctaaatggtatgattttaaaaattaactgcaatgtgtttagctaagcctgaactttttaatttctccaaaccataagatctcaataatttttttcgaataaaagatatgcttgacttataagcaaaggtcactaactctaactaatttgaagaaagcctaatctgccttagtaaaaaaatgttggaatatagaatatttgggaaacagtattaacataatttgttttattaatgaataggatactatatgaggtatcactaattacaaatccccatactagagccttatgggcaaatagtattcctgaagtaaaataattcagcctattcttttcatatgtgttcttttataatgtgttgtttatggtctaatttaaatacaacaactgattatcaaaaataatgaaaatacaaacctttattattgatcattggtggtattcctcaattaatatggttttaacaaggttcttttagttttggtcagaattttcatgcctttatgtcctaatgaagctattctttataccaaattttattgtaggtgaatcactaaactttttaaataagaaggaacacattttttgtaggataacaatattattcatgtttgttttgaatttagcaaaaattgttttattgagtcattcattcagcaaatattgactgcatatatttttaatcttaggatctgttctagcttctgattaaatcaaaactggtatttacttccccatatttttctctttgctagagaaagcaccagatgtatctgactatgatatacctgaccacatatatctgacttttactgatttttccatatcttttttcctgcaagtttgcctctgtggctaatcaaaatgcttgaggactgaaagtcgtataactggaaaaaagtacagaatgttctagaaaacaaaatgcctcttccacatccttgtgtagacctgcggatagtctctacacactagacctagtagcatcgaatcaactgaataaatgctggagcatttaaatccgttgccattgccatctgtttaagatttccacatctttaacactatttccatatggatagtcaatatgtttttgaggtttctggtaaaggaatttcactttaaaaagagtctaaaattgctaattgaattacactgtcatattctcaagcaatgtatgtagttggtgggaatgtaaagtggcacagccactgtggaaaacagtatggtggttcctcaaaaaattaaacatagaattaccattggattcataattccacttctaggcatatatccaaaggaactggaagaaggatctcaaagagatatttgtacactcatgctcacagcagcattagtcataatatctaagaggtggaagcaccccaagtgtccatggacagatgactagataaacaaagtgtggtaatttacaatggaatattattcagtcttaaaaaagaagaaaactctgacacatgctacaacatggatgacccttgaaggcattacgctaattgaaataacccaatcaaaaaaggacaaccgtgttatgattccacttatatgaggtacctagagtcctcaaatgcatagaaacagaaagtaggaaggtggctgccaggggttgcagggagagggaatgaggagtcatcgtttaactgagacagtgtccgttttgcaagataaaaagagttccggaagtggatggtagtgatggtcacacagtcatgtgaatgttccactgaactacatgcttaaaaatgattaagatagtaaattttgtatgtgtattttatcacaattaaaaagatttttaaaacccttatgtataacataagagcaggagaatcagtaattataattaatactgagaccatttaatccttaagtcatgccagaacaaggacacgaataggccaatcacatcagacaagtcaggagtgagaacccagagtcattacatcatagtgcatcacaaactcagcaacagaacttcagtctttatacctacccaagggctgaaattatcaccttctatcaaggtaacttttctaagtctcgagtgtggtatctttgacttactttggaaaagcaaaaacaaaagtgtacatttctcatacaatgcattcttaggacagaaaaaaaaaacagtgtaaaatacattgaatttaaatccttagccacacctgtatcccagcactttggaagctgaggcaggaagtttgaggctagatatttgagaccagcctgggcaacacagcaagaccctgtctctacaaaaaattaaaaaatttgccaagtgtggtagcacacccctgtagtgccagctactcaggaggctgaggcaggaggatagcttgagcacaggagttcaaggctgcagtgagctatgactgcgccactgcactccagcatgggcaacagagagagatcctgtctctaaaataaataaataaaaccttgtgtttaatactaagaaaatgaaagtgaacaaagaaatctggaccaggtaaagggagttattgtcattatgaattccccttttatagatgataaaactgaggcacagagaggttaagaaacctgctgacagtcacaaagtgaatccgtggtacaaacaggattcagagttcacactcttaaccacccaccacaaagatagaggtgtagggaggttgtggtgttaggatttcggggaatggggaggatttgctgtgtacaagtaccaaagagggaaatatcaaaaccgaagcccatcaaggactcaaaagcccaaactctgtagcctatgactttacgagacgtctagcaaggagtaataatccattttggctctagctgaaagggcggttcaagcctcctctcagagcataaaagtatggtttctattatacaaaatggaaacttcctagcctacaacttctttcctaaaatagtacatgctgttccccacatttgtgttgtcaatgtatttttaactgtaatgtgaagacacacttctcagcagaaaaaaatgaaggaatgggaccaaaatgacttagggaaaggtgccagaattaatttgccagccattcagcaatcagtcaaaggcagagcatttcctgaggcagcaatttatcctttggctgtcacatcaaaccccagctgttttagaagagcgcctagcaaagatgagcagatgatgctctgtgggtccttattcatcaaatacacacgggatcatcagtgagaacaggggactgagccaatgaactagcttgcctacacctctcatttactgtcttatttatctactcttcattatctaatttttcatccagtctagttgaacctcccaagcaaatggtttcacaccaatccacgggcagacagctcccccatcaaatgtaccttccaactggaaacctcagccttggctccacgggaagtcacaccttcctgatcccaggttctgtgtgtgtcactaatggtgggttggtaatgatgccttttattttttatgcttcctctgattagagtgaaactgtgtttctctaatgctaacagcccagtgaatgtgaaaaattcaactctcctggctgggagtatgttacagccatcatgatttctgttcccagtaaaaagtctgaataactgtgttgattacagccaaataatcttgcaaaagtccacctctacccgtgaagtcatgtaaataattccaaagattgtcatatactagtccttatttaattgaaaacaggcaaattcttttaatccaaatatacattatattatgcacatcaaaaataaagcactaaaaggaaattataaaaaccaatgaccattatgttaatagctgcaataagaagagatgagtcgtaacatatacacactaacactgcccaaaacaggtagtagaaggttagtgtattcacaagaacttactacatttactatttttaaaaagtctatctgaattttcagtaaatattcttcctataaaggatccacagttttaaatcttagaagtgcttaataagaattagagacatttgaatgaatatttatatatatcaattatgcaatacattgtcactgtcctttataataagattgtctgaaacagaatgcagtcatatgaactgactggcatatcttagatgccattaaaacgtatttatcatgaccccacaccccccaagaaaaccccacaaaatgtgtcaagtccttgcctacaatactaaacatgaaatcagaattgatgggctctaagttgatgaatgtttgggctggttactaaaatggatggggggtcatttgtatccattcctcaacagcatgctctgtcaaggggaaaagtttaattgaatcttgcgttttctcatttcttgctgaaaagtacgatgttaaggccagcaaggtattaagaagacttcatcatgggacttgtcagattctctcctcctctatttccctctatgttccaatgtcaacaaacttgccccagtttttatcaaagggcatgtggttatctccttctctaccccttcttagcctcttcgttcttcagtataattgcaaatcctaaaagcaattcatagaataaacaaaatgaaatgtttgagtcttgttagctgaggtccaaatggtgccagcacagagaatgcctcactgcacagctttctggggtggagttaactagtgatcaagttgaagccaaaggaagaaagcagaagagaatagtgatttgcaccttttcagaatgtatttcttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggaatggacttgagccaaatctcttactcccagaccagtgggctgcagactatcaaatgagatttcttccatcaggcattatgaaaaagaatcaacccacacgaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagtgttacatatgtggcaggaaactggtctttttttttttttttttaacacatagaaggttttgccaccctatcctcaattttctctccaatatagaaaaggtgtttacacttaagagccttttttaaagattggcctattcactctctgttcagagaggaatttggttttgcaaccttgctaatagtaaagaacatatttacatgtccttcaaataataaggattcttaaaaataccactgaaaataattcttatttgggtaaattgagcaggaagtaaatgttttcagtcagacgtctgccaaaccaaccccagaatagttcagcttcgtatgcagggttttcaggacagcccttcttaccccatctgaggtgagggaccagggtttagcttttatttctaatatccattcttttgcaaaatctaataaaaatgaattacaggccaggcactggctcacgcctgtaatcccagcaatttgagaggccaaggcaggaggatcgtttgagcccaggagtactagacctgtctggacaacatgatgagacaataaataaataaataaataaataagaattacaaaaaaatgaaaagacaaatccaatgcaaggtacaaatccaaaatttttatcatagattcacaatccatataaaattaatccatccaattgctttgaaagtttctaagcacttactctcatcttctgtacttaactcgtcacggatgagtatcaaacagctcacagtccccatctatggaccatggaccacacttggaattgtgctggtccacaacatggcaccactctgtcttaaaaatctgacttcccataatttcccctgcttcagaaaagcagaattgttctcaactaatacttcacagaaagaacttgacaaaacttaatagcaggtgttatctgaaacaaaggagaatggggaggggattctgtggtggcccctactagaatgtgggaaatgttgaaggcacagatttttacctgaatctccactgcctggaactgtgcgtggtacatagtcatagctcaataatagtttctgaatgaatgaaataaacttgggaagcacagaatttaacaaagccaacttgttttatttaattttattattttactttcagcacaatactccttagagtatttaacatgttaagaggaattgtaaatctccaagaggagaacatgacttttttgtttttttgagatggagtctcgctctgtcacccaggctggagtgcagtggtgcaatcttggctcactgcaagctccccctcgcgggttcatgccattctcccacctcagcctcctgactagctgggactacaagcgcctgccaccacgcccggttaattttgtttttgtatttttagtagagatggggtttcactgtgttagccaagatggtctcgatctcctgacctggagatccacccgcctcggcctcccaaagtgctgagattacagacgtgagccaccgcgcccggccagaacgtgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatagtaactgcacacatctctcaggaggccatgtgggctgaatgagatgatcagtacagaatgtctagaacagtacctggtacttagtaagtgctccatgtgtggtgattagcattaagtaccatcacagcatttgacttctctgacatctgaagagaactacaatgaggtggaattccatttccgtatcgactgtaagctccttaaaggaagagctgtcttactcagctctgtatcttctagaaggagcagcacagtactttgcaaataagaggtgctgggttaatatctgctgagttgaactaagcaagataaaactggagagagaggcctaaagaaacaagaacaatttttctaggcatctgatcataagtaagcatgaataacttcaataacttcatagcgtttagtgttggggcatgaaataaatcaattctgcttctgagcatggaaaaaatttctgcactgttaggatctaccagggagtatgtataactgggtcatttttacacttcccaaaaaacttcttactatgagcaatattttctgggaaatttttcattacagaacatcttgggcttcttagcaactgacttacggttttctaaattctaaatccgataacttggaggcttgaatttgaaagacaaaactctcaagaactgatatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaaaaaaaaaataaaaaaacaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtcacccaagtgtcttggcaaaatccagtttctcatgccttagtcctgaggtggggtcaagtctatgagtctgcatttctaacaagctcgcagatgacactgatgcttcccctatagggcccacattttgagtagcaaggagctgttcccaaagacggtgaagaataaggggcaagtattctccatgatgccttgaggacaagagattcagaagaatcgattacagcctaaaggatttgaaccagagatgaaaaagaatgctttccatgaagtattgctagatattggagccagttacagagaaagcttttagacaattaagcacaagatgggtatccaagtgtttgggctgttgtgataattagcctaaacaatatttcaggggtccagatttatctacttagtctctctccattgattcagtgaccccagtaatagctgaatctccattggaatgtgggttgtgtagatacagaagcaatatcatgactatattgaattcaattaaaaataaagtttcagaaaatggccctgatttgcatccctaatttctattcaactttcccattttaggacacagtattgagtgtgaggacgaaaacgctcgccaacccagtcctgttttagtgacagcagattctgggtacttatgtctcctatcgccatacaatatggcctaataaagtcgcgccaaagagactagatttcatttcagagcaaagggttcagtcgtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgtcagttagagaatattttcacaggaagttagaagcgatttcagaaattcccctctgcagtttctcagagtggatgttaggcctcatcaaaaagacatttggttcagagattgaaagtgggcagcctataaattgctgaggtatttagctgggcttagcagttttcctttgaggaggaaaccatgatcctgagtgctcactgagtacagcagggaagtgcctaagttcacgcagcctctggcttcaaaaaatcccagccttatcatgtgctcctgagccaaggagcataacctctccaagccttaattcccttcacctgcaaaatgagagcaacactagtacctacctcctagggaggcagctgaaatgaggtggtgcatgtaaagtgcttagcagggtgcctggcaaatagctaacatttgtggagtactttctatgcaacagatgagcatgtgttctaaccatactaagagatggcatttattgagtttgtaccttgtagacagtctatacatgtcagctgtcattataagtaatgagtgatagtgatagtgatgatgctgatgatgctgatgatagacaagatagctctactgctcagacaaaggaactatgccaattagatgtggggcctgtgattcatggcttcctattgcttagctgctgctagaaaaggctggaacatcagtgatcatacagtggttctctgaattgaagagaaacattaagcagcctgagtttgtccccaaaagacagcaatattctctggaggtcctctctgccacccatggactttcctaacggccagtaagttaactctgggtagatatgatgataagggagaagttgatattttgaggggacatgatggtctcccaaaatagaaaatggatcatgtgtgggtagcaccattaacatgatgcaggatcacccagcctggctttctgaaaggagccctgggcaaacaggaccctgatgaccagaatgacacttgcccacatctctcagttagtactccccacacactattcgtacctgtcgttctccttcctatcaaatggctttgctactcacttccagccttgcctccacgactgattttgaatggatacctagcatatccttggtccacaggatgagtgtgcaaaaaaaaaaaaagggtacttattcaaaatattctttttaaaaatacttgtccagcttgtatttggaggacagacagagcagtagatggggtgatagagagaggaatgatccctggtcagagtcttcagctactgaccctagtaattcaatcttgagcccaattttgcatactcagcaaaagaaaagttttgcagtcaagcagacccatgctttttagaaagcaagttataaaatatctgtcattacttgaacatgccatttgggaggaggagactcatccctcctagccgaaaaaccgtatcaaagtattcccccaaataccttattaaagtattcaaagtaatctcaaactttctgcctcctgagaagagttctgggaagcacacttttctatttcttgttgcatttctagaatgttttaccactcattgtagttcagcatccccagaaaactgacaggcaggccatcaccctgcagttggtataagatggaaagagggagaggacttgctatgatcctgtttgggcaaagagacccctccctgtccccatgctcacctgtcccatgagcaagttcaagtcaataatacatgtctatccactgaggtaactcattgcagcacacagctgttctccttgcagtcaacaccagtgcagagctctccctgggcaaagctgcacttgctggatgggttttcattaacatatgggaaagaatagtcagcaaatcttcactgttgcagaggactgggaaaaaccagacagatgcacctagttctcacctatccatgcagacaaaatcatctagccttagggagtggagggtgaattgccagagacgctgaaggggttgggaaaaccagtgtcatttaggttgatgaacaatgctgctgccctaaaaaatgtattcagtcagaaaattctgctgactccgtatctcaccacaaagagctccagggaccttccccgacatcagtcatttacaaaagtgttggcaacacaaaattgtaagcactgtaggtagggatgcctttatgccaccttagagggtggttttatatcaggattattcctctatcttctcccatcagtgatccagttctgacccagtctcaaatctcatcacaaatagaaagccaaacagcacctacctccatctcttaagaaagttgaaggagagaatttatagactgaggggtaggtgctttcatatacggataatctttcaaaaataccataagctcttccattttttttacagcaggtaaatagggagctaagagaggttcagtagccttccccaggtcttacagcaaatcgcgtcctaatcagagtcttataatccttgccctgtcccatcctgctgcccactgcacagccgcacaacccccctcacacttcacaaaccagggataacaggaagggtgagggctgtggtagcaattttggataatatagtggtccatgggtacttatagcagggaaatactatctgagatcttcagatgatcaaaattgaatcctagttagactggaatacccaatcccattctgaaggggaatcaaatattcctctttcagttgttcttgcctctctagcctatttaaggagaaagagaaaaaaaatactcaaccacagatagaaatgtccttctcattgccaaattttagccaaaacaagaaatcaacagaagcttcttaagaaactatacctatttgtcccagtctagaaaaaggagaaaggatagaatccatcaccctaaaaagcaatgccacaggtatgggggccaggaataaacagacttccacagccagactgacaacaaagagcttctgcacaccagcatcagtgggcacagagatatatgttacttctcagtgggcagagataccctatctacttacagggtatggaaaaaagagaggaagtgatgactcttattcatagatattaattagttacatccacttcccatcctccagtgtatacagagtacagccatcaagacaggacccctgtatttctccgaacatgaaaccctaatcactgggactgcatcactcgttaccatgaaatacatgtggcagttaatgataaaaaccacaaaaattacactcagttcaaacgttttattgcatgccattcttcaagatggcagatggctgcctaaattgatctcagtgtcatgttacaggtgcccctaagtttctctaaatcagccaaatgagtttgaagttgaaacggccacctcacattgttctaccaggagacgcacaggatgccactgtaatgcagtttgctgaattatagtattcataggctctgattaaaaaaaaaataggtgaactacctgaaacttgccccacagagaatgattattgaatatgctaaaaagccatgatgctgatgaccctgacttaaaggcaatattctccccattctggctgtacagggcaaacatagcatatggcggctaaagagatatctgagttactggttctgggtaagatggagttatcacagttcatcctgtctttcccactgaatgatgttctaagacctggacagaatgcatggagcagctatttgaagacattgagaataaacaatggcaggtagattgaagaagacccgaattagaaataccaccaaatcagcagtgaatttaccattgttctcttctggtatcctctagcctgacctcgaggcagccagaacctggaagggatcatcaagatgtggacaaaaaacctccaggagaagcctcatagtagaactaactaatgcgaggtaactcttagaaaaaatggaggaaatcactgtttttccctccctccctccctccatccattccttcctccctctcttccttcctctctttcttctttcctttcttcctttctttttctctcctcctgtgccccaacaccaagccatctagtagtggcagtagcagtggtgacaatgcaagccagaaaaagattaaaggagataggagaattttcctctctgcccaaaaaacctatggtcctgagagaatgaaaaccaaaccctattgctttttgtctctctctgcccttctaccagttggccccagatgtgaacacaatcacagaaagtatacagaaagccagataactaaagcctcagcagcccttccatcaaaagatcaaaaaggaagaccccagggaacctgaaaatattgcagagatcacatagaaagaggacatggggaagtagtcactaaattgtttataaactctggggctcacgctaagctgtgcatggatgaaactgaccctacacagcacatttagattctaagaactaaactacaatatagaccaccacccagtctgagggcaatattggacagatccaaatagcactgccaacgctttgaaaactcaactaacattgaagtcacaacccatagaagccccataagaacctgtagcctaaaatcaagccgatcaggccgggcgcagtgcctcgtgtctgtaattccagtatttgggaagccaaggcgagtggatcacctgaagccaagagttcaagaccagcctggccaacatggcaaaaccctgtttctactaaaaatacaaaaattagccaggcgtggtggtgggcacctgtaatcccagctacttgggaggctgaggcaggaaaattgcttgaacccagaaggcagaagttgtagtgagctgagattgcaccactgcactccagcttgggtgacagagtgagactccatctcaaataataataataataacaataataataataaagtaaaataaaataaagcaggtcattaccttccaaaataaaattatcaacattcttacaaaatttaaacaagaatcagagtttcataataaaaaaattaaaatatccaagacacaataaaaaattacttgccataagagtaaccaggaaaatctcaacttgcatggaaaaagacaatcagcagatgccaatgcctagatgacacagatgttggaataatctgacaaaaaccttaaagcaactactatttcccgataactaagaaagaacacatttgtaaagaagtaaaagacgggatgcataatttaaaaatcaaaattttaaaaatcaaatggaaatactacaattaaaaaatacaataactaaaacattcactgaatgggctcaacagcagagcaaagatgatggagggaagagtcaatgaacttgaagctaggtcaatataaattgtgcaatttgaacaacagagagaaaaaagtattgaaaagtttcacacagagcctcagggtcctctgatacatcagaaaaagatttagcatttgcatcataggaatcctagaaggaaagcagaaataatatggtgcaggaaaaaaaaatttttttgaggaaacaataagtgaaaacttctttaacttccccagagacaaacctagcagttgaagaatctcaatgaactccaacaggataaacccaaaagaataatgcctagacacattgtaagcaaacaacagaaaactaaagacaaagagaaaatctagaaggcaatcggagaaaaatgactcattacttataggtaaccacaattcaaatgactatggatttctcatcagaaacaatggaggcaagaagaaagtagaacaacacttttaaaatgttgaaccctgaattctatatccaccaaaatgtccctaagtaatgaaagtgaaataaagatattttcagatgacagaaaacagtgtttgttgccagagcatggctctgaaggaactgctaacataagttggacaaacagaacaggaatgatactaaaaggaaggaaacaaagagaaaacaacaacattaataaatattagaataatataatagactatacttctcttgaattctttaaaatagataaaagcaaaaattataacattgtctgatatagtttgcaacagctgtaatacataatacaactataacataaaatggggagggtaaagaaacctatagtttggtaagggttctacatttcacttaaagaggcaaatcatggaatccaagtagacttaaaaagttaagtatgtacattacaaacccatgagcaatcaattttttaaaaactatataaagaagtataagaaataccacagaccaaaaaaaattctgaaaatgttcaaaatgattcaaaagaagaaagaagagagttcaaagtttttgaaaaattagtctaattttcaaaactgaaacaggaaacaaacagaaagcaaataaaatattaggcctaaatccaaacatataaataataatattatagataaattgtctaatgcaaccaattaagaaagagagattcaaagaatcgatttttaaaaaatcacccgactataaactgtctataagaagatcacttaagttttaaagataggtttggttcaaacaaaaaagaggagaaaagatatacttttttccatgaaaacaccaatcaaaaaagaaagcttgagtggctatattaatatcagataaagtagacttcagaacaaagaaaattacaaggatatagggataatatataatgataaaaaggtcaattcaccaagaaaacgtaacaatctaaagtatatgcacttaacagactttcaaacacacacaaagcaaaacctgacggaactaaagtagacaaatccacagttataattggagacttcagcatccttctcgtagtaagatgcagaactagcagacaggaaatcagcaagggtatagaagaaatgaacaacaccattagccgactagtaataattgacatttatagaacactctgcccaacaatagcagaatatacattctttttaagctcacctggaacattcaccaagacagattacattctgggccataaaatgcaccttaacaaatttaaaagaattgaaatcatgccaagtaggttcttaaccataatggaatcagactacaaatcaataatagaaagataagaggaatatcttcaaatacttggaaattaggcaacacacttctaaataattcatggatcaaagaagtttcatgtgaaattagaaaatattgttaactgaacaaaaatgaaaacacaacatatcaaaatttgtggaatgcagctaaagcagggaccaggaagaaatatatagcacaaaatgtttacaccaaaaaagaagagtctcaaatccaaaatctaagcttcatcttaagaagaaactagagaagaggagcaaagtaaatctaaagcaagcagaaaggaaacaaacaaacaaaaaatacaggaaataataaaaccaaagccgattatttaacaaagatcagcaaactttatatctagtaagagtgacaaataagagagaagacacaaataacaaaatcaagaatgaaagagtggttatcactgcccacattaaaaggacaataatgggatactatgaataactctacatacataaattgaaaaactcagataaattagaccaatttttcaaaaactttgaattgtcacaactcacccaagattaactatttaacctgaatagtcctataaccattgaagacattgaatttgtatttaaaaactttcagaaaagaaaaaaatctaggcccaaacctagtagtatttcactgccaaatactactaaatatttaaagaaaaaaaaatcaccaattctacacaatttctcccagaaaacagaaggaagggaaagatttccaactcattttataaagccaacattacctgacactaaaatcaaagacagtctaagaaacgtacaaactaatatacaccaaaaaacaaacacacacaaattcttcataaaaatattaacaaaccaaatccaccaacatgtataagaaataatcacactaactagggtctctcccaggaatgtatggtggctggttcaatattgtataatcattcaatgtaatttaccatattaacagtctaaagaagaaaaactacatgatcctatacattgatgcaggaaagcatttagcaaaattcaacctccattcatgattgaaaaaaataaaactctcaccaaaatagaaatgggaaggaactccctcaacctcaaaagaaaggtatctacaaaacatctatagttcatatcatacttaatggtgaaagaaatgaatgttttcccttgaagacaggtgacaaagaaaagatgtctactcccactccctctattcaatattctgcaagaagtgctagccggtacaatatgattgccaggtacaaggtcaatacagaaacataatgtatatttctacataccaccaatgaacaattggaacccaatttttttaagatgtcatttataatagctccaaaaatgtaaaacttacatataaatctaacaaaacatgtacagaatcttgatgctgaaaactataaaacactgggtaaaacaagttaaagatgacctaaataaatgaagagaccaaattgatggactggaagatacgacatagtaaagatgtcagtgctcccccaaattggtctataggtttaatacaattccaatcaaaacacaggaggaattttttttaggtataggcaagctgattttaaagtatatatggaaagacaaggacactagaatagccaaagcaattttgaaaaagaatacatttggaggactcaaactttgtaatgcccattttaagcaacagaagattgttcctagaccttgaagctcaatggagtttgccatattggaatctgaagttgtttggttccggtacctcctttcatccttccatattctcccttttggaatggcactgtctatagccattatcctatggctgtcctgccattgcatttggggtgcagagtacttgttttctagtttcacagatccaaaaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattttgcatgtgggatgaatgtagatttttgcagaagtgattaacgatcttgtgataggaaggttatctaagtgggctctaaatgtaatctctattgtctttttagaggaggtttggctaaagaagaagaaataggagatgtgacaatggaagcacaatgttggagtgatgcgatgacagggacaagagccaaggaatgtggtcagcctccagaagctagaaaatgcaaggaaacagattctcctctagagcccccagaaggaaccagccccgccaccatgttgactctaactccactgaaactcagtttccaagttttggcctccagaaaaggaaggaaaaaaacttgtgatatttacagcaactaggtttgtagtaatttattgcagtagccataggaaactaatacatagagtttcatttatcttgggtagatatctaggagtggtatttctgagtcatatggtaactcaatgtttaaccttttaagaaaaactccaaatatttcaacttaaaaacttctttccaggaaagaaagtttaagttaagaaaatgaaaacacaagctacagattaggggcaaatatttacaaattgtatatccaacgagatccaaaatatataaagaattcttaaacagtaaaaaacaaattcaaagaaacaactcaattaaaatggacccagcacttcaccaaaaagcatatacagatgacaaataaccactgggaaggtgttcaacatcagtagggaaatacacgtgaaaaccacaatgagataccacactgcccacctactagactgtttaaaataaaaagtattgacaatgccaagtgatgataaggatgcggagctacagaaactcctgcattgcttgctgatgggaatgataaatggtacagtccttctggaaaacactttggcagtttcttttaaagttaaatataaacttaccctataatccagcaatcctaattcgagatacttaccctagagaaattaaaacttatatccacacaaacttccatgtaaatgtttatatcgactgtattcatgatcgccccaactggaggaaaactaaatggtgtccaatggatgaatggataaacaaactggtacctgcatataagatgtcatactattcatcaacagaaaggatggaatactgatacatgcaacaacctggatggatgtcaagggaactatgctaaatgaaaaaagccaatctcaaaaggttacatgctccatgatgcctttacatgacagacttgaaaagacaaaactgtaatgacagagaatagatcagtggttgccagggcctaggagtgacaggagggtgtgactgtacagcatgagggaatttgggggtatggaaactatcctgtatcctgattgtggtggtggttgcatgactacacatacacaaaatcaactttactgtatgttaatttaaaaaataaaatgaaaaacacttctggaaaactataatcatttccaaatcttactggaatcatgtaccttcagcattttcctataatgcaaatggattactctgctaataaccttgaggacttatcaatccaaagccccaacacctccactcgaattgcttgagttacttgaatatttttgttatgatcagaaggtgtctgtaaacattaggattaactatatttttttctccaagatacttttctttcttcatcttattagcactacctaacccgtccggatctcactcccctttacagacacatttcacacatgggaagtctatcatactgcactgtaacctactgcttccttctttcaaatggttgagactaaactttatagctttcttacatgtccctcaacaaaccagtcatcatctcccttctgtactcagttgcgtcccttggcttgagcaatacatcctcccactacaaggcattatggtctagacaagacagcacttgcctgggtcttttccagactaagctaccaccaagggaatggggcagacatatgtatctcctaccttggaaaagagcttaatttttatagtttttcatggttgaggggaaacctaggataagctcattttacaaatgttgcaaagtggtttctattcttagaagctattgatttgaatataaaacaaagcagtgtttacattcaagacatttctcttggagaagcaatgtgtaacagtggggaaagcgctgagctgagaagccaatgatgttgtagcgttctggccctagctctaccattccccaaccagccatgcaaccagaagtcatcttccgatttcctcctcccaaagagctatggtgatgggtcctgtggcttactattctacaactgaagaaaggtcagagacattaggttctttgcatttggcatgttttccatatgtatctggtttccttgtgtatctggtcaaataaagaatttaagtgaaaatgtatatctcagccaggcacggtggctcatgctgtaatcccagcactttgggaggctgaggtgggcacatcacttgaggtcaggagtttgagaccagcctgggcaacatggtgaaaccccgtctctactaaaaatacaaaaattagccgggtgtggtggctcgtgcctgcagtcccagctacttgggagactgaggcagcagaatcacttgaacctgggggctgcagcggctgggttgctgggggagaggtgggcggaggttgcagtgagccgagactgcaccaccgcactccagcctgggtgagacagcgaaatctccgtctcaaaaaaaaaaggtatatcacgtaaactgaaaagtgctgtgcaaacgtaaagtattactataattccaaagttcttaacagaatacccacggtatcaaatcaatggtgcttccttgttttgcacccctagatgtgtagaatagttgcctcaaagttccaaattcctcatcattgttctggacacagattcacacttaaaatcaccttagggcaacgacaaccaatagacttaaggaaatctgatattttattccttatggcttacataggactttgcgattttcatgtaacaatcactaacagtggatggcactcaaaaaaccaaagtcaaaaatttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggccccatcctcgctgggcaccggactctgtgtatatgttatgtaatctttctgtgctgcctttctctttgttcagtccatgccaagacccatataaaagaatccatatgtgattacagctataaaaccaagaggaaaatattagatgaaaatataacattttggggtttctaagtttgctttacctttaatgctaggcagacagtttacacaaatcattttgctgcaaagtaaagaataatgagttaaatgtgttccctgtcaccatcaatcatgtacatttgcttttgattcaccaaacatataagacacatgaaatgactttctaatcatgttgggggaaggagggagaagggaagaagatggggaaaggagtttcaacttcttttattttattcagaagatccgttgacattttctggcaatctatcttctaacatgctgtatgggcttctttttgctaataatgtttgccttgagaatttgtaaaggtctgagaacgctttaattcaatgttctagaaattaccagggccataggggaaatgaatccctgttaatagctcatggattacttctctctttattagaaatagttttcacagaagttactctactttcaggtgggcattagtgggcttggtcagactgagtggcactgcgggaggcagcatcctgcatggaagcctctgatctaatgggatctaagtagggtgaaaagcgggtacacagtgacgttgacccaaataggatactggggtttagcaaattcatttcaattcatgggtgtttattttgatttgtgaacttaaacaacacactgactggattttctggcagttgaagagctttataaccaaatctaaccagcctctgcacaatccttgtcaaggattaaagagctttgcatttcatgtttctacattgaatcaaagctctttaatttggcaagggaatcatatacagtagcaaagaaagaagttttctgcaccaaaatcacaccaaattacaagtccccgctggtcctggtcccacccagctgtctgtaatacaggctggtcaggctaggctgaggccaaccgatgcattcatttactccacaaacacgtattgagtagctattatgagtcaggcgctgttctaggcactgaggattcagcaagtagccccatcttcacagtgctcaccttgtcccagggaaaagaggcaataaacaccaaagagtgccacgggaaaaaacaaagccaagagagtaaataaggatgtggatgtatggtgtgtggagggggagggggtgcagattcctaaaatgcaattctgttttttccacatggaaacttcatcccccaatgaagctgagaagaacagctgtatacttcctagagaatatgaagtgggacatctactctctctagagaccctcacaagccccagagaacttgtatgagcttagttactttcttcctgattttcctgtatttgccagggaagttgttgaatcataaagtatccctttataagaaatataccatattcatagattggagaactcagtattgtggagatgtcaattctcccaagagaatccagaaacagacccgatcatgtagtatcacctgacttatttaaaaaaaaacagggggttctgggatatttgtaatgtactctttgttaatctaggtcctggttacatgagcactgagggtataagtatttaacaggttgtacatttattacatgcacacttttattatatttcaataaaaaattcatttttaatcccttttaaaaatgcagttctaatgccttagaggaaagactcaactgagaaattaatattaagcaaagacaacaagagttggacagaggggagccaagcagctgctcagggaaggaatatccagccagagggaacaagaagtaaaaatccctagaccagcccaagggagtgtggctaacataagaagcaggagaacactcaggacttaagccaatgaggttccagggacctgactgcttaggacctgcaggccattgtagggactttattcagatgagatgggaccccatggagagacttatgcagaagagtgacaggatctgattcatgcttgagaaggttgttctggatgctttgttgaagatagattggaggtggggtggtaagggcagagcagacagaccagttaggaggctggtgtaatattctaggagagacatgatggtggtttggagctagtagtaggagtgcaggtggtgagaagtgctccgattctgggaatattttgaaacttgaaccaagaggatttcctgctgtattgaatgtggtgtttgagggcaaataaataaatttttaaaaatgagtcaagggtgactccagagtttttagtttcagccatgggaaggatggcattgccaatagtaaaatgagcaaagaacaggtttgtggacaaagaaaaggaattcgattgtggaatggtaagtctgagaggagatggggtattcaaatgtaggtgttgagcagcagttgaatcggtgacgccgggttcaggggagaggttcttcatggaaatataaatatggaagtcatctatgtatctaaaagcaatgagaataattgagattatcaaggaagtgagtataattgtattgggagctgctctccactggtgaggaatatgtgcagaagtctgctgtcataatgccatctgtggttagggtgacattgtccatgggtaatagagtaagcaacatcttgcatctccctatctaatttccaccatgtgggtttactttgccagacaaactctctactctggtaccactagttgttctttcctaagtagagagccacctcaatcccagccttatcagttgcagccctggccccatttcagagctcttgtcaactccaaccctgccacgcaaggttgagttctgcttctggtatgcctccttcaacctggttagcagagcttacacccaccagacaataagaattgcttgctgtgatgattaatgttaacttgactgggtcacagtgtacccagatatttggctaaacattattctgggtgtgtctttgagggtggagggtgtttctgcatgagattaacatttgaatttgtggagtgagtaaagcagattgctcccccaacaaccctcaacccaacccatgtgggtgggcttcatctaacccactgaaggcctgaatagaataaaaaggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacacacacacacagagacaccattgctctgtttctgtagagaaccctaatatacttactttgtcccagaagcacctacctaagtcatccccagcccttcagctccacttggtttagactccaattagtttcacctcctcaaaacagcagtgtgtgtcaatcccttcttgggagcctagttcattccttaccctgactcagcccagcctagggtaactgttatgatgcagtggcctctgcttttgcagagctgggcagacagaaaggtaaagaagatgcacagaatggagctatgcaaacatgtgcccatacatccaagtcagaacagaagctttctgaagcttaccagagcttcctagacctaaggatgctgatgggattagcgcactgtctggaacatggtaggtccccagggcatctctattgcatcaatagttcacatagaatgaactatagaaagctaagatttgtgctaagatgatggcactagctaaagttttcccttatcgtttctcacatttcctttcagtatactcaagggcaaacctggaaccagtttgcttgggtttgaacacctgagtttgtgaattccaaatcacacatccgcatgcaggttgttgaaattctcttaacccatagtgcctgccactgtaaaaggaggataataatagtgacaagtttgggtatggtcattgtgagaattaaatgtgatattgcagctaaagcacttaatacgggatttagcacatgggaatcagtattttttagctattattaaaagtccttgatttacatttttagctgctaaaccagactaattctatacatacatatgtacaagcacacatatacacataaacataacccagactaaaaatatttaaatgattcccttggctatggttagtgctaggacaaaaactttgtgtgtccagccatatccacttcagccaagatacaatctgaatagcatgcttctgatttctctagtgcattctcattcagaaacagaaaacatgacagagaagcgtgtattgttatcgatattaagtaacatttcacccgcaaattccaaatcttgcggcatagggaaaaaaaaacaacactagaaatacataacatattttcttcattctcaaaactgatttattcaacaaagaaataatcatggagagcatactgtgttccaggttttgtgtgtgtgtgtgtgtgtgtgtgtgtgtgtgtgtataaaatgatagattaacagacttcaaatagttggcaattctgagaactatttaaatgtgctacattggaagtcccaatgtacattgaaaaacaattttaagagttaatcaccctctaaacacacacacacacacacacacacacacacacacacacacacacacacaatttgtcatgtgcaaagacagctaatcctagtaagaatgatagcacaattcatgaagatggcaggccatgccccaacttgaaacctcatacgctgaagagaagctaagtatgcatagtaagactcaaaaacaaaaacaaaaacaaatcaatggatcttaaattacatccaagtgaggaagccaagtagagagtaagtgtggccacttattcagggctgaggcaatagcagataggctaagtaagttcattgcctgggtctttacagaagacagcagggagagtctcactagaacctgacaggctaggagtaggagatcagacagtggcaaatgaacagcatgttccagggctggctgatgatgtgaatgcagataagtcacaggcaccaggatgttcgtgcgaactccttaaaggaactcaagggttcaaataagatcctattgcacaaaatgcttaacctgtccttaacagcagctgctgagctggaggatccctggattgccagcttgagtctctttcctaaaggtattagatataaaattagcataagatttgttaaatcctagcactgcagaagctgtagagggcatgccttgaagtttaaatggagtaaattaaggacaaatagccagaaaaaaaatatttagcagtagttagcaaagttaagaaattcattacccccaaagatatgggggtatataaaatataaaaaagattcctaaaaagtttagatcaattcagagatatatccacataggagtgaggttttcagggacaaagacttagggtcctaaggttggtatctttgagagtggcattgatggagagataaagaagcattgctccatatttcttggtacctccaggctgggcctcttttgtaattcctgtatgccagtagtccctctttctttttctttcttttttggagacggggtcttctttctctgttgcccaggctggagtgcaatggcatgatcttggctcactgcgacctccgcctcctgggttcaagcaattccccggcttcagcttcttgagtagctgggactacaggcatgcgccaccaggcccagctaatttttgtatttttagtagaaaagggatttcaccatgttggccaggctggtctcgaactcctgacctcaggtgatccacctgccttggcctcccaaagtgcttatattacaggtgtgggccaacacacctggccagtaatccctctttcttttattaaacatatcacccccactttcagtcttggcattttggtctcatgcatgataaaatgcccagtggaagtggctcacacctatataatcccagcactttgggaggctgaggcaggaggattgcttgaacccaggagtttgagaccaacctagacaacacagggagactggtctctacaaaaaattaaaataaaattaaaaagcccagtggatagtcactgtgcttctgcctgtgccacatctttgctgttacagtcttgtttctcttattttaacaggggttctgccgcaccaaaaaacagacacgaccggcctaggggaagggagagggtgagctaacactttaccttggcttccagaaatgctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacaaaagtaagtgagggctttgtgatccctggaatgggagataatacataaaacatgccaaggagggtgccattatggtgttcaccatgacctaaaggagacgaagatctgggatttggaggtaagtacacaaagatagcaatgtagaatggggagcatgtgaataaggcatctctattttagctgagaaaaatatatgaggggaaggcttgtgatttccaggtcatgtaccttagccaattccaacacaaagaccatctcagtgtcaaaaggtcatattcagagagctacttccaaacaggcgggaattggccttatacagaaataatgtggtaacataacccccagaggaaaatgtgttttcagttacaccagggccaggcccagcctttcccacaagctcttcctaaataggaacttggcaatgggattagctgagctggagcggacatccttggctttagaggtgaggcccatcagggtctggaggaaggttgggcagaggttttccctgctgctaatagcactgaagaatcagcatcacatccattttattaatttccttgacagacagctctagttaccatgcaggcaccacaaaatcaaaacatacgcatgtcaaggggccccatctgtggtggggccctgccaaagcccatgttacatcaacacgaggaagcagagcacagctccacacaccatgtgcttggtcccatgggccatgccctggaagaaaaccaccagagcttgattgaaagagccagagaagttctcgtggtgacagtcctttatcctgagtctgggcttttcatgttgaacataagatccctgggagacacgtggctacatctggcttcagggtctcgtctctaaacacagctacacagacctccctgccacctccattcagttccacccatgcaggatgagagcagcctggattaaagaagatacctaaaggaatgcaacatctttatttgtaagctggatctgagctcagagttctgctgagctgagacctttggctgcataatgagcataggaggattttttaaatcaaggtatcccttgctatcagtgttgctaaagtgattgaaggagctccaaagcaatttgttcctttatgtggagcaatgttaactatcagttggctacataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacgggtttgtcaccttgactgcctaatctaagaacagtctaaggatgaggactggagtgactgttatcccaggctccagaagcccccttgctagtggctgggcgatcaatgcaaggctctggaaacacaatcctaacctggcccaccctgggaggacagagtcggttttttttctctccttgcctgcactggtgcagcaggtatggccaccttggggactctggagtgtctgtccagccagctctgacaaggacatgaacacatccagaccgcctgtctctcggtgcaaagggcactgctgccgaggactcagtacattgtttcgctctccattcaaacaaccgcggcatgtcagtcctgctggcctccttgattgtgcagaaataaataaatgaattatgctgttggggtttgggcttcagcacaaacacatggtctgcatttatccacacagtgagaggtccaccagccacttgatataaaagagcaaaatgataattcttttctttaggcgctctgttgccatatggaatgtatataaatcatatttttgttttaacagcggaggctttgttgatagataaacatgtggtttatctaaaaaaagaggggattgtgctttgaacaatcatttaatggccgtggatgtgccaaataaaaataaaaacataattttgaaagaagttggcttcatgcccaaatccgtaacaaggaatttctccttaacccaagtggttagagcccgtcgatctgttttgagtttaagctgtgctctctactcaaccccacgacaaatggaatcccgagctaatgtgctctaataagacgagacgttacctttatgaatgacctcatggagaagaggttggcaagcatggtggagaggccttgagccaggcagctctgggctatgaagcccaacttcaactctgcgaggcagattgcgtcatcaccttctttccaattccagctcgggatgtttagcagatgggcctggggaaagaaaagcaggtatgagaccttgctctgttaaatgttcaattgtttaacatttcttctgggaaatgcagcattgcccaaccactcagggccatccagtcttgcccttcttttcccttgctgcggtctgatgtttgctgttttatgcaactcttctgctcatcacacttcagtctctctggactgttgcttctgcacccaccaagcccaagtcctcccctgggtttgtcatttagccaaatagagcccagagggaatttcctcttgtgacagacccaacagcctgggttactaggatgtctagctaaatcattaagttgagtcctctaatagaccgtaggagtgccaaatgcctgtatattttcagtttcttttttacctgcctttccaatactccagatcagtgactcccaggcatcaggagcgggcatcagaatcacctgtacagtttctgaaaacacagattgctggccccccaccagcatttctgattcagtagatctggggtaaggctggagaatttggcatttctcacaagttggaggtgacgctgacgctgttgatctaggggccacactttgagaaccactggcctaaaacatcaggtaaatcacagtgtcgacgtttccaatctcttgcaaatggactggtcctattcaacccttatgtcaggccctgagacaagaacccagaggcatgctcatccaattatttttaagtggcatgaagcagagagtcatagaaaatacattggatgaaagaatcaaagttcaaaaggttctccagagttggaaaaatcggcaaaagaccaaactaaaaagatttacaaggctttcatgtcaagtacagcatttaggctaaaaaaaatcaactatataaattcaaaatgagaagacctagcttggcagcaggcaggagagaaataaaagaaaacaaaacacacaaagctaaatttaagtgtgtgggtaactaaaacctcaaattttaggctagccatgtgacattacagagaaagccagtgtttactttttagaagtgctccccagatcaagggaaatgaacatttcattctgttgtgaattggtcagactagttccagagtacttgatccagttttcagtcagatttaaagagggaaaatgatcaactgaataacttccagagaaaagtgacaaagacaagaggaggtagcgtctggaaaagatcttttgaggaacagttaagacagccagtaatatttggcctgaagaaggctctcgtcctcacagagacaggatggttacatctgaatacttcaggtgctgctgtgtacaagattaggtttgtcctgctttgttctagaagccagaattaagactgactggtatatattccaagaaagcagatttttgtcttgttttataaatgaacttcctaaggatgtaatttgtctaccaaacggagaaggttaccttaaaaaatgaaaggtctttgtccctaagactcagtaagtatttctccaagttactatggaaagaacttttgctctgcactaggaggttgaatcagagagcccttctaagtctctgctagtgccaagattctatggctttgaagttattatttctctgcacatctcagcaaacacaaggagcaccaagggagcattcccttcactttcagaacaatatacaatagttgaactagaaggatggaagactccattgtgaaaacaaagagcaagtccaagggttccacactctgctttcaaaaatactattcttatgaaattccttcttgcaaaatccgcttctgtgacaatcttgtgcatcctaagccaaaagtgggtactccagggagagatgacagtgccctccctgatgagagcatggttaaatagtctcatggaggggccacagcaagtggtaattgctgtcaaactatcaaaggaccttccccacactgcagactcaattccaacaactagccctaccctttattccttcctctccctactctccagtggcttcagatggccactttcccttttacttcctgggcatcgtagagaacacattggtataactggagaaatactcacttgcagtaatatcatctgagaacctgagaggaatgaggagaaattcagtttaagtaatgaacaagtcaagcattgtgtgtgaaaggagatttttttggtccaagccctaaagagacagctctgaaccttcatggcaccttcaaacaaacaagcaaaacctttcagagaaagtctctcctatccgcatgtgctatctaaggtataaggctgaggcatttcatccttgggtcccccatggccctgtctggtttgagttctgtaggcatattttgagctttctttctcactgtccaccttgacacttggccatgtgattatatagaaaagttgagtttgttccttatctcagggttctgtgccctctttttttggatattatattttctccaacgcagggaaggagtgagggtgacctgctgaatgcttggagggaaatctctgtgcatgaaacaaagagaagagactgacccaggaacataaatcctttgtttctggaaacttcgtccttttccatttgaagtaaattgagtctgatgaaaaatgccagtgttagtgcccagaagtctggaggcaaatcctctctccctaacttggagaatataaagagcaggtctggcagacctggctgcccttcatttctgctacttcaccacccctccctcctctcatggagaaggaactggaaatacgctgtcctggaaaaccaggagagatggatttcagtcctagttccatctctcactacatacaattttgggaagccactatgaggaacaaagaaggccatgaaagaggaaacgatttaatacaattgcccaagtgtcagggtggacagtggaaaaaaaaagctcaaagaacttgcctctatctgcactgggctcatgggacttggcttccagagataaaggcctctttcactagagtctttgggaaaaataaaaaatccactgagaggtaaatcatcaggagtgatacttttccaagaagttataaaccaatctttccttgaagagctttgagccatttacactcaaatcagaagatgcagggccagcatttaaaagatggccagcatgaaagcgtttctctccaagaattctagtgatattaaaagatacactttggagagcatcagcccttctataatgcctactctcgggaaccacagtttggttcaatgggctgtggctccatttaaagagtcggtggcagtaagctcttctgtctccccgctcgctggctgcagagtggtggccatgatttgtgcccagcagagctgcgctgtctatacagagcttagatgccctgctctgaagttaccctgggatgctaaaatgcacagatggtccaacgagtactaaagaagataatggatgtcaaagctcttttaaaaccataaaatatgacacacatgtctacaattatgatgatgacaaactcagggccagttttacatggagagaaagtaggcagcttccctacatccctctaggccctagaatattactattactggatcataggggattgaaatgcttcatatttcaagcccgttgtccaattatgaaatcagctatctcttggaatatgttcatagtgacatgactttacaggcacataccaggtcctttcctgaaagcaaattgtaatgcatggagatctctaagcatctaggatgagtgcagcaaaaagtgccaagaaaggcagaaaaaaaatgttgaaagggaagaggaagaaaatgtattgaaagagtaggaaacatctcaggaaacacagcaaaactgtgaagcaaggtgaagaatgtccatttgcaattctacaaggaatgaaagacaaacaatgatgagtggacgttttcttctttctctagaagagagatatgaaagaacaacaacaacaaaatgccctgtgtcaaagtcactctattccctgtgtcctgactaatcatccaaggatctgtaagtgattctgcccaaccccaaaactcgaatagtttgggatggttctaaacaaaatgtgttttaagcaaataatcatgaattggttgatatcttcctcactgtttctgaataattacaacacagaggtttgccaaacacattcaggttgctatgatcatgtgattactgaccagggactgtctggatcccaggccggctgagctgctttgagttggacaataaccacagctaaaatcctccttaatttcttgaagatgctgcatcagcactcattggaaagagaaaaaaaaggaactgacaaccccttctaaacatacaacattaattttcctattcaatctaaattcagccaaaaatctaaacaacagcttaaagcactcccacactaaatgaaatttcagatcacaaatgaaagaaggagagctcgttgctgcaggagctgtcactagtcacagccttgctaataaaattcacctccacctacaagggctgccatcaaaaacttctccagcttgacacccgtacattaccaatatcctcactttatctcttcagtgtccttgggttttccagagacaaacaggcgaatgtgaccttgggtgcccaccaccaaatccgttggctggagaacaacacgttctgcaagggagccacctgccgagggctgggcagtggctggcagcagtcagccgttctggatggtgggccagtcactgacagcaggctccactcagtgacagcctctgatgggcctccacacagcaaaatgggccagcacttgccagcaattaagaaataacggcatggcactggtgcatttggcagaatggggtttttctctgcatcacctgactgcctatttcatagggaatatggcccataagagggggtacgctgttactcataacccagcagcgagttattctgtacagacaggacacctggctccaggtactgggcagcctccggtttctaggtttcattaaggacataactggtactgcatcaaatggagaaaggtgccaccttccctcccctaaagctgtttttttggaagtttattgactggctgagagaaggagcactgcctttgaatgagacactggactctggtttactgagaagtaatcacagggaaacagcatagactctgacttttgtcttctttctaatcaatcccccactgtaagctataacacaaggaaaattcctttctctttaatctctggatagcttactattttcctgattcaactctgcaaattctcatctcgactctgggaatgtgtcccacattacactcttacagagcgcattatgcactcactagttcacctggtctcagatagagaaatcctatcactcacttgcctggagcattctacaccttaactgctaaatccccgaggacacaaaatagggcttctccttcactgatattcctgtgggtgtcagggagagtgctaatcacacagtatgtattcaataaatatttactgaataagtaaatgactgcagcacatacaaataaaagttgttgtaacttaagtatggatgggatccaagagtaaatcaatagttctgaacctcgggttccaatagacacttcccgaatgaatgaatcagtacatgaaggagcatccttccagtgaccaaatgcaaacacgttgtttggactaaagaaatgggccagaggcgtggtggctcatgcctgtaatcccagcactttgggaggccgaggcgggcagatcacctgaggttgggagttcgagaccatcctgaccaacatgcagaaaccccatctctactaaaagtacaaaatcagcctggcatggtggcgcatgcctgtaatcccagctactcaagaggcagaggcaggagaattgcttgaacttgggaggtggaggttgtggggagtcaagatcatgccattgcactccagcctgggcaacaagagcaagactccatcccaaaaaaaaagaaagaaagaaagaaatgtcccaggaagatttttaacaatcacacctctttacccaggtctttgagttgcgcacatgtgggcatgtgagagtgtgtgtgtgtgtgtgtgtgtgtgtgtgtgtgtgagcctgtataatgaggaagaagaggctggacctgtggatgggtcttcagacctggagcgggctctcgcactcctaccttgttgtgatactgcagcatttgagtgatgattcttatcttcggatggtagttctttatggagattactctgaaaaagaaagaaccaatgctgagacaggtctgccttatgcatggtgtctgacaaaaagatcaattttactgtctccaaatggggtacccatgggactgaggtaggaggcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtcctttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacccggtgacccagaagttactaccccttccctagaaatttttgcataagctgccccttaatctgcatgcaattaaaagtaggtataaatacgacagcctgcccagagctgctactctatggtgtagccccgctgtgcaggagcagtcacagagctgtaatactactgcttcaataaagctgtttccttctgccctaccatcagcttgcctttgaattcttttctgggggaagctaaaaaccttcatgggctaagccccattttggggctcacctatcctgcatcaggaccagcagccagggctatcctgaggggttgcagacactgggccaggttaaacagtattcccaccaccatatctcttgctagtgtgaaaacaaaatcacaaaacagccacagtctgtgtcctgggcatgaaaaatttgagggccccttggaatgcattggagatgggatgtatgcatgtgcgtactggggagtagggggcctggagcaggggctgccagcttattgcctacgtagacatcgaaagcgagcccaaatcatggggcctccagaggtttgcaatctcccacaccctagggactagcccagaaacaatctgctgagtccaattctccaagttaacaacttgagacaacaatgacaaatcaaacaagcaggatgacaaatggttctaattgtgacacatgcttggccactatcacaaaaaatgatttctaagcagggcttttaggatgagatcaaggactcagccttccatagctaatagagaaaatgatgacttaaacgctggttaaaaataagtgccaaggcattgcgggggtcatgatctggtggaaaattgtctcctacctgccctcagtccaaactcaatgttaagcatggcctgcacccaccccaggcctcacgtgtcctccccacatcaattatggtgctaaagggaggggcagagcgcagatgaatggaaacacgtgggttccagtcacagctattgtactaatgaactgcgcgacctttaggaaaaccctgggctctctgttcctgtttcctcatctggacactgggagcaacagtacctgctttatttacttcacaggcttggtatgagcagcaaatgggagaccagatgtgaaaatgctttgaaatcattaaaagttctctccacgtgtaagttatggtttttgtcattaccaagtctgtcagaagtgacattgtacatttccttctgtgacaaggaaggctaaagaatggaattccacagaaaggcccacctcctaagcctaatcagaaatgcaagtgcatttattatgaccacccccacaaacttcccacccagcagcgctccccacttcaccccttttagtgcagaaatggagagaaggcagccagggagcagctttatctgaaaagctgcaacgtacgaatttaggaaatggatcacgctaaagcctctcccagcacaaattcaccctgcgtttttgcacttgaaggatttcattttatttttgaaaaagtgttgcgttggcccacgcttataactcaaggactttgagcctctgtcagccctgccttgcagttcacagcttcagccagttttctgcattagctcatttcaaatggatctttgacattttaatttcaaaggaggcagattggtctcattaaactgaggaggaaggaggattatacaaataagagaaagacaaagcccatttttaaccctgaacttcccacttctttttgcagccaaggcctcagttctggctctacttaattacatttctgatactacctttgaccagtaatttctttttttcttttctttttttttttttttttttttttttttttttttttaagacggagcctcgctggctctgttgcccaggctgtagtgcagtggcgcgatcttggctcactgcaacctccgcctcctgggttcaagcgattcccctgcctcaacctcctgagtaactgggattacaggcacacaccaccacacccagctaagttttgtatttttagtagatacggggtttcaccatgttggtcaggctggtcttgaactcctgacctcgtgatctgcccaccttggcctcccaaagttctgggattacaggtgtaagccactgagccccgcccttgaccagtaatttctatgcctccttgtcctgccagtcaccctagtacctatgtgtcttcatattaaccctaccacagttagggtttaaataaaatactacaattaagagaaacacccatttcaaaactattactcaggtagccccaaacatctctgtggagtcaaaacattaagcttcatcttcttttggttttccatttggaattttgaagacagtgaagccaggttccttaaagggttacatttttttttttaaatcatttccaatgacagaaaaaggtgtcaaaagttgaaaatccttcctacttcaaagaaaggaacaagtgacacacccaaccctgatcctggtgtagccactgtgcagctgtaactgattcgggaatgagcccaggtgtgaagccagaatctgttccaccctctctctgcagcctggcaagcccaaagcttagaagagttcacgcatccacttccttaaaatgacctcactaagcatattgccaaagaaaactgagtggcaagagaagatggtgccagatgttgcctgccagacacaaggaccagatgcttaagggaggactggctcctctgaaatgcactggaggaattcccccacctcactgatggggaagctccggtcacttggggccactgatggaaagcaaagacaaaggcaatgcaaacattgtcaggatgtaaaggtaacttcttgaccttcaacctcaggtaagttcccaggaggcagtaaaccaagccaccggtagagggggaaccttcggcccgaaagatggctgttcacagttaggtaaaagttcctgggaatgcagtgggacggaaatcccactgaatttagctcaactctccagaagcttccctttatcatttcctctcagccctcttaactcttctgcaatttatgctacagaaaagacaaattccaaagggcctctaactacctggagcaaaataccttgactttttagtcatttcattgtcacacaatgtgactactgggtttatgcaaggaacaaaaactgaacaattgctttttttctgaattaagaaaagaataaggtgctggtgttggggccaatattagcagttgacaggcctaacccttgtgcacaaaaagcactgcacagtgtttcccagtatgacctcccctagatgttctgtaaaaaaaaaaaaaaaaaaaaaagggagggcagggcagggcagggcagggccacagcggcacactcctgtaatccagagttttgggatgcccaggtgggaggatcacttgaggttaggagttcgttgagatcagcctgggcaacatagcaagaccctgtccctactaaaaaaaaaaatctaaaaattggccatgtgtggtggcacattcctatagcctcggctacttgggaggctgaggtgagaggatcgtttgggctcaggagttcaaggttatagtgagctatgattgagtccctgcactccagcctgggcgatagtgcgagactctgtctctatgaaaaaaaacgggggggggttgggggaggtgggagaggagcagaggcttatagtcaaataggtttggaaagtgttctatagtacgttatctcagagatgcatattagtattaaaagcactgaaaagcctttcaagaaagaacattaattttgggaaactggatgaaacagcctaactggtcactaaattcccctttggggtgataggaatcaatatgccgtagacacacttggaaagccctagtaagggttttctcagcctcgacaccattaacattctgggccagacaattctctgttttgggggctgacctgtgcattgcagggtcgttcgcagtgtccctgggctctacctatcagatgccagcagcacggtcccctagttgtgacaaccaaaaacatctccagacattgcaaaatgtcccctgggggcatctgcctttagttaagatatctcaggcccatttcctttagggaacatggtactttaattcaggccagcacccatctcaatctatttcctagttctgtctcaaggaatctcaaacccaaggccagctgtaagccctagagctgccacctgctgagggtgagcttccggttggtgacaccctgtgtgccactgccccaacccacacagacagcctcggctcccccaggcctatgcagctggtgagttgtacagtggcttgtggggcaaaaaggcctcatagagatagtcctctgcagaagatccaaaagggccgtgaacagccacagactgccaagcccagggccttccgcagcgccccaagagttacctcatgatattcgaggcatcctccgcatccgggtcagcgcagtacttgttggcaaggatcaggcatgcatctgctgactctatctaagacaccgaaaggaaaattcacagaacacaaacatataaatagccatgctcgagtgtagtctctctctgttgacagcttcttggggaagctttgcaaagaaaaaaaaaaaacaatcctgagagcctgagagattatagtttttgtcaaaagtgtaggttccaagttcttgttatggtataaacatttcatcttgttgctgttggagggtacaacatgtaccttggtaattatacttttcatttggcatcgttgcttacttgtaggatttccagatttctttaaataacaattaattaagcctttcagtctcctccccacctcctttctcaaccatctgcaccatcatcctaattcttcctatcaggagttggaggtgggtgggttaaatcccttctctccagttagcaaggtaactgagtattggggattcagaaatgtacactctgaagtccttcatctgacctttttcacatcttcattttctataggctgggaagagatcagagctctaaatcagataacatcaccatattgcttagtatccgattagtattcagatattcagaagacaacaaatctatgtatgaaataatgtgttacagttgaactcaaaatatacctactgacttatccaaacacgagcccacaggggtttattccttagaggggaccatgagtttgatgtgctaatgattgcttgcatttaaattaggtccacgaacaataacaattgtccctacgttctcataagattttacataagcaataacttgagttatgtctggataatatcaagattaactggactctatgagcataagaattcttatgctggctcaggtctgcaatctgtcctacttggtatgttatacttaatagatcattcctggattttgagggaggccataatatcctccgtggtatgtcacaaatcatctctgatttctttaataatataaagaaagaatttatccaaatccttttggattattcatcttggccaattatattatttacaaaattatgcggtgaccacagttagcatttagacttcagtgaattcattatattaatgtacaccccctggcatgcaaatattgaacatgcttacaaaatctatattacataggtaaagtagcagatgccattttgccttgtacctttcccttctaagcctcaggtgtgctttatgagaagattctaaattaccagtttctggaaaaaaagattcgcccattatcaatgatatcagataactgcatgtttagttttacaccctgcgtcttagatggggaaaaaagaaagctcaaatgttttatcgcttagtaaaattttattttatattttagcctaatgtttctttcagatgtaaataatagaagtcagagctatattgagtccaacttaagtgttcaatataggaattacttgattattatgttgtataaagctactgggtccatataactggtctacttccttgatgagtagctgattttgaggaatccagcaaagcaagtttcatgttatgaccagtccaagtgtgggatggttataggtagtgttgcatatgccagcagaaggaggtcctgggaccagtggaagggtgacctcaaggttgctggtatgtgattgatctcattaggtgtttaggagatgactcgtggccaacctaggaggtgtgtcccctcagcacagagtcaggactccccccagacccacaccaagatggaataaaagcagaagtcacctcttcctccttaccttgactcttgcaagatcatgtggattgaggacggaaccctgataaaattccacctgagtaaaatgtcgtttgaacagagcttcaagctccaggttgggggagatgctacacagggagagaagaaatcgctattaatttaatggactcgggggtttcagcctccatgggctccttcctctctaatttccacagggagccctggggagaggctgtgacctacagtcacccttttgcttgccataaataaaagactcacactcaagagaagtaaaaccccagcccaactgaaaaccaaaccagtaccatggtaaaagaaagaggttcatgggctttaggaaggccaagacctcaggacaaatgtcttctcttcggtatgaatggaattcctatcttataaatatggaagctgggctgcgccactagtgggatggttcattttatgcggactgtgccagagggtgcccagatccagtgtgatttctgggtgtgtctgggagagtctctggatgagaatggcatttgaatcagtgaattcagtagactaccctcctttgtgggagtgggcatcatccagtcctttgagggtctgaagagaacaataaaacagaggacagaggcgtttgtcccttttgcttctttcctgccggcttgaactgggcatctcttgtcattctcctatccttggactggggttgacattggctctatgactctctggccctcagactcaaacaccaccagctttcctgggtctccagcttgctggtggcaggcagtgggacttcccagcctctgtaatcaaatgagccaattcttcctaataaatctctctagagatagatagatagatagatgtatcaatatatagataccgatatatatctgtattagatatattgatatatatatttcctattgactctgtttcactggagagccctgactaatacaatcaaggattagccgaaggttcccctgggagaggcatcctgctgttccctccatcatgaaccttatctctgcttctgtgtctcatggacttctcatcccccaaggcctggatcaaaaagtatcactctgaggagccacagacagacttaatttactctcattattgttcttgattcacacacatgtatgcgactcatcacatttcttggtgctgatctgtactgacatctttctctttggaggacaaggattaaacaagtgacctatttattcatttgttaattctgcagagatgaaaaagactgtcgataaggtaccgtgctaggcactgggagatgatatttagttagaacctactatacgccaggtaccgtgataagtcaacacttgcctaacatttgtgaagtccataatgacaataataataatagttcatgttttgtaacatttactatatggcagataacattttaaataaataatagtaaaatagtattataaataaataagtaaaataaataatatttatttattttattttattttacttagagtttatctctgtcacacagactgcagtgcagtggcaggatctctgctcactgcaacttcccaggttcaagtgatttttgtgcctcagccttcagagtagctgggattataggcatgtgccaccatgcccggctaatttttgtgttttcagtagacacagggttttgccacattggccaggctggtcttgaactcctggcctcaagtgagccacccaccttgccctcccaaagtgctgggattacaggcatgagccaccatgcctggccatgatgagcattaattcatttaaatctcaaaacaaccctataggcaggtatgttattaacccagagcttcaagaggttaattaactgggccatctactataagtatgacattgatggatgttagggatacaaaggtgaatcctagcaatggaagcatgagcagccagtttttgttttgttttgttttgttttgttttgttttttggagacagggactggagtgcagtggtgccatcttgactcactgcaacctctgcctctcaggatcaagtcatcctcccaccacagcctccagagtagcgagggctacaggcacgtgcccctatgcctggctaatctttctatttttgtatagatggggtctcactgtgttgcccaagctggtcttgaactcctgagctcaagtgatcttcccaccttggcctcccaaagtgctgggattacaagcatgagcaaccacaccttaccagcttgtttattcaaactaaagcagtggatgagagaaaagtggctgcctctgtgaatctgaccagtctttcagacccatgacaagtcatacctcattcagaagcctgcccgggtaataccatagactgatgctccttgaaagagatgtccccagtcacttctgccacctgatcaaaatgacttcagcatcccttggataacacagggttgatgttgtctctaatggttgcatgtgtgttcatcttgaaatgcccaactcatgtgggggcacagcctacacactatacctctagagaactttccaaaacgctcagtagaggatgggccacacagcaggtaatcagtggctaagcactgaatggaacctgtgggtacctgctcctgtgctaacatagcctggtctgttttttcaaagtttggagaaatcagtgcagaaaagagaaatgttggtgccccaacatggtgacaagtcagaagtctagcattctgtgagcaaatgccagaggacgacgatccaccaaacagggagtttgtagggaagccgacctcagtggaacctcagagtaggaccgcgtgctgggtagtcaacagcacgtcaagccagcacaaacatgttagctttgtcctggactttgcgatgtggtgccaggactggccccatgacagccccatctccataaaagaagatgaccatggtaccacacatgtcaccataatggagccccctaattctctccattcctggggcagactaccttttatctaaaaagaggattagtcaaagttgaaaacctcaacattgggtagaagggagataccttgctttcctcccctgtaaaacatacaagataagacctacctcctaagtggattatacaaccaaatatatgttatttttcaggctgatagctaacacttattgaagacttactgcacgcctgactctgctctgcacacttcatatggattaattcatttcattctcatcacagcccaactaggtaggaactactatcatctccatgatttatggatgaggaagctgaggcacagggagcttaagtaacttgctcagccagtagttggttgagtcaggattcagatcagggaatctgagtccagaatatgtatttttactctgtttgtggagtaaatgggagcctgcatgcacagtgacgggctagggtcccatgctgggggttcctaggaacggcagttgttattactattaccttctgtcctgcttcctcttaagttggtgtcttgcttggtcaccaactgactccagaactcctaacgtatccacaccatacagctaatcatcccacagcagataatgtggacacgccagattgctaaggggacaatgatgatgacttggacccacaatgagctccactattatttcttccagagataaactcggatgtggtcccagaatcgcctccacagaggcagactctgctctcatcattgaaccagtgtgttgcttccctttccattggttctgcaatatcttctccaacgaggccaaaagggatcatggcttacccaactctggccccatccccagtgccattccccaagacctccactcttacagacattcagggagtccctcgcagggtgtgtggttgggcagagggtctgacagcagtaggaagctcttacttgtgaagaaaaacgatctccacattgacgtcatcccggtccttgtgcagaaagtccttcaggaagttggaaacactctccagagtgatgtgtccgcagaccacaatgtgcctgaacaggagaggccagttagatcaggccaggcaccacgacaggaccctgcatcccaccccctggcaagacagcagaagccaggcagctgcaggggaagcattcatctcctccctccgcctccataaaagcccagctcccatccccagagggcagtgaggcaaagcagcggtgctagcaggtgctgagactcctagacagaaaagccatatggcttctcacctgatgctgcacaaaatcctattaaaagcccaactgtttggccaagtggttttatgcatttaacaataagtgacattatgcttgtgcttaaatgctgcattatcaagtcccttgcagattcatatctctccctttctgcccacaaagcgtcctccggggagatttactgtatgagtcttggtttatgacatagagcttatcaggtaatgagataacaaatcttgctgaaacgatgattttgtgtgtaagaaagcagacttttatcagggtggctaatgtgcggcctgacacgttataggttctgctggccataagcagtaaaaaggaaattttgcatttttccactataactcctccgacaatgggggcatgtaacactttacagtaagtgagcattactcagggctaaatggggctgggatgcctatggaatggaagatcatgccagctggctgtgcgtccccagagggctgcttccttagggtgcccgggatttccaggagagctaaaggaatttacctcaagatggggagatgctgggaagggatgaggctggaattgctcgccttgtttgagggtggtttggacttctgtttctggaagtagtggctcacccggaagagatgagccccacaactgttgagactgacagtccctccaaccgctcggggctcctggccaatctgactttggcaccaggcaatgtcatggccacttatatgtgccacataatgcccagtcaggagtgagcatttgatgcaagagtcagccacaagacaaaaagccagggactgactgtggagataaaaccactggcttctagtgaagagactgtatgtagcaagaggctcgactcctgtccctgtgccccccaggctcatagtgacagcatctgagtctctagctgcgctctgagacttgggcaggtggtgaacatgcagcatggtaatttcctgggtaaaatttagaatggccatgtcccttgcacttcataattgctctgtgcacattccactaaggcagaaagctcattggctggaggtggctcataataggaggcagtgatgatggcttatgcaatgttccattagatgccattataagagcctgccctttcgttgtaatttggtgcttgactaagtatgtgagaataatgcagtaaactcattggtgaaaggataatgatgcagaacaaagagtaaatcaataatatgcacgatgcagttaataatatcaccattatagactgttattgttacggtggtgcacttagcaatcaggcacgcagcggccaccaaggtgagggaagagtgtcaatgagctacttcagaagagatgtcttaacatgatcactttgctctcctgctaggttgatgaaggtcccttagccacccacccaaattttatgcccaaagcccatatgactaaccccctcattagtatatggtgagtagtatgaggctaagacagtgtgacacacagtgtatcagaatacacaatatagattgaacatttggatgatatgcattttatcatatattttaaaatgtttcttgtggcacatgtacatttacatggacaaaatacttcaaataaatttgcacgttctgaataagatttcagactttgaatttgccaaatatgtttgaagtgaatgagaaacagaattcccctactgacctaacttccttgcaactgacaatagggctactttgccattctaacatcctctgcacatagacttccaagattaggagcaaagccaacatgaatccaatgcgtgggtatctccacaggacagatacgtggctgaggctgttctcatcacttagatgtgaaagtaagccagatgtgattccctgctctgcgaccaagggtgtgggcaaagtatttattcccattcagtgcaggaggaagctgagaggttaataccacccagccggcctcctgtgccaggcattgtaaagttcgaagttctataccagcataagcctggttattactcaaagctaggctcaaatcaatgataggtctggggaaatgcctgaacattcgttcttcctacccagcatgcaaagaactgaatgaacatcagccagcatctcctcctcctctctgaaatcattcatccctaggaaagatgtgtgagaagtgcaaggggaaaagatgagttcccccctctcacccttgaatcaaaagctcagctggctgatttattcagccttagaaaaagtcagggttctcttccttgaaaatgtactgggtacatataaaatatattccaatgcaatcaatattatcccttaagcctttaattaactttcacttctcttaagaagtagacaaatgctggcaagagtgaggagaaaaaaaggattgacttttttcatttggtgctagctatccaataccattctagacaattgaaaatatatatcttttagccacagcatgatttctggggtggagagctgtctttatcaaaaaaggaagaaaaaaaaccttccttcaacgtaattggtatttttgctcagaaaaaaagcgagattgattgaaagcagattgcctttttgcccaaggagagttattaggtacattatcatggcaaccttggagaacccatattgttccaatctgtcctatatctgatttgaagatttatggcctcccccttttgtgccaataatcatttccctccattttgttttccatacagtgaaagttatcaaggagcccacatattgaaaatgtttgaatgcagttagaattgatggatggggagaagctgcctctaactcagcaatcggtattaggagatctgcttccgccagcctgtgtctgaggagggccctgcaagagcatgagggatggatggtgaatggggaacatttatttaccagaaatattttcaagacttttgaagattctagggccatagtttggggaaggatattattgcaggaagaagagaactagaatttattgcatcctcaattattagagatatcaacacaaatatgttaagatagacagcagggtgtgacctcattggaggcagagtaatggttgttcacagggcatgatttgaagaatgccaaaaaagatccccatccaaagttatctctgttgggttccatgatgcctacatatctaccatgtgagattcatactctgatagccctgtgttaactcagctcagacactaaataactaaatagtcttggacaatgtaccaattttgcattttacaattaaaaagccagagcctttgaggggccagagctggtgcctgattcatgaagttatcctgatatctaaggagatgatacatggaagggccaagtaatctgctccatggtaagcactatgaaatggtaagtgccatatggtatctgtaaattaggatgtaaccaatataaagtattctgtggcctatgcaatcccacctaatccttcaacaaccctgtgttctcactgcctgagtcttttcaggtaacctctctgaaactctttccttaagtcatatatgcctggcatcccacagcaagtaaaagtgacttgcccaggatgcaatctgggtctcccacttcagttcccactaagatgaaggtggtggtggaaaggaaagaggcttgtatatctcagcttctgctccttcagggcaagcagaaatggacccacagaggtcctcctggatacatggtggagggggtgttggaggggtcctccactggccaagggagaggtttagtctgggaactggagtggataaaccatcacagttttgcaagatcactagagtctggctggataggcagtatcatgatagtcttagcaaagtctgattacaggcagaaatcataagttccaccggtcaggaactctaagccaaacttaactgaagccatatgattggagcaagctaaggggctgcaaagtgatgcaaatgtccattttattttatattatattttatttattttttagagacagggtattgctctgttgcccaggctggagtacagtggctcaatcagaggtaattgcagccttgaactcccaggctgaagcgatcctcctgtcttaacttcctgggtagctgggactataggcatgccaccacagctggctaattttcttttggtttttgtagagataggttcttgctatgttgcccaggctggtcatgaactcccaacctcaagtgatctgctcaccttggcccccaaagtgctgagattacaggcatgagccaccgcgccctaccccaaatgtctattttagacatgtcatgtacagctcaggacttcctcaccagcctggaatctagaagataataagaatcttaatgatccatttacaatggggaatatttaggaaagttcagctatgagagtagctaaatctctccccatctgtggatgtggatctgaactttcttagaccatcagcgattgtcctgaccaatttctatagggcctgaccactcaatttgtgaagatgaccaatagtcctcaatcaataaccatttctgatctgatgaagtttttggttttaaatgctaggtctggatctgtaaacaaatatttcttgggcaaaggtaacataaaatagatataagctgacaggtcatggcttagaataaaagatccacctcagaaacacaaggaagcatcttcaatgccaaaatagtatccaacggcactttctggagaggaattattcatccagtgtgagcaagtagtgcctggtgctgggtcagggctccataaatatgggctggtttaactgaaaagggcagtgcggtgggtcacggcattggaggggtaagaatgacttcatgagaagaagtttgatgattatgaacactattgagggtcaccataaattcgccagttgcttatttcatgtgcatatcttcactaaatatacatgggtgtgcttctcctgccatttaagcatcgctgcctccagaatgaaatcccacaaattcttctcaatccttctactctcttctcagtgatgggccaggaaagcctgcatgcccaagttgagccagaacttcagtttcagagctcaattccacaggtacacaggacaacctaggggaagtgacttaaggcagaaggcagaagaggacaggagggcagtgactgaggcatcaagagagccactgaagatgacttttaggtctatgacaaggaaaatctacatacttttcccaagcctcagatactggttgttagagccagtagcctttgaaaagggaaactgtgaccatggaatagtcaccattgggccccctcccacgttcttaagtttatctcagcatctgaatgaatagcccttggcaattgtttaatctagcacctttcttctctttgatgtggaaacaggttgcaagatgagtgccagatccagagcacaacacctccctcagtttcatgccttctgatgaaagaaagcagctggtgccagggaggataacctaagctgggaattgggagactggggggcgagttctcagtgacctggggccagtcactaaaatgaagaggcccaggctgactgggctgcacccaccagacactgatgaatcctcacacagggctccagttctctgtccgaccttagttcacacctccatcataccttatctagacatctgcaatcgcttcctaactgatttccctatttactgtccccactgcccccaaccattcccacactccctcaaaaaagccaaagagaagggatggcagcaaatcctactgcgatcaggttctgcgagggcggggaggccttagatctttctttagcagagcctcgctctaggaagacaatgtaaaatgcacagctctgggctgtttatttttaaagatactatatccatttttactggaacgagtataaagaacttaaaaaacccagagctatcttgtcacaataaatcagacagagtaaattgaaaatcctatacagctttgcctgaatacattgtgctcactttgtcaaagaggtagatgaaatgtggcacatattgatctagatgtctctgtaaaactataatatttatatcaaatacatatgctagactctctgtctttctgctgagccttctaattgtgttttcctcgtcctgctcctcccaaaatgcatctcaccattggtagcccctgacatgatgggaatgaattttaagaagtacttctcaagagaaccagcagcactgtatcatacaggaagcagggcgtggggggttagagacccaacgacctaaaccacacagtggtcagcaccaaagcttcacgtttgcccccctaggttgaccttgaacccttggtgtctgcatcaccacctctccatgacactcctgcaagctggcctttcctttccttctcacctggtagtgcttttcttggctacttagtcttaatgcaggtttccctgatttggggcatgtccttcagggttactgtttcccagcgcttcccttgaggctcaatcccccactgccaaaaaataagactaatccaactcccaccttcccacttcctcctttactgaatgtctcaaagagactgacttcagtaaagataggggagacatcatgggcaaatgaagcctaactccaggctgtgctgcctcatccctccaccctaccccaggacctggcttggaacccccaaaacttgctgggctttcaggaactatttgttaactgatggattggttgacaaagtatgcatcttggagactctatcccatggtaagtgcagaaaaaagttaacaggtagttcactgcaagccttttagaccataggcttattccaccaccctgaatctactagcatatttcaagtttgtaagggatctgtacacataaagaaaaataaaaacaaagcaaatgagagtgtgtatcagtcccacaaccccaaaccctgactatcaccatttcctgttaaaataatttttttaaaaaaaaggaggttcagcaataagataatttcctatccatggacacatctagtactttgctaatcacaaaggaaggaaatgcattctccctcctagtgaggaagtgaataaagtaatcttcttctccagctgtcaatggagctgttctggatgtggcaggctgtgctgctgtttccctaaatggggcagaagtctgagcaaatagatcccaacagtgcagcaaaggcacctctaaagcagagccccaaggtcagaggacagacaactggcagccccagtggggaataccgggatgtcccacctgggccaaaactttgcatcttatcgcatgcagacagtcagaacctcagctaccctagagggatctgtgtctacacctccaccatcccaaatcacagttagacctccataattagaccgtggtgagaaatgatcacacatattttgtagcttgtagcctacatggagcctcagtccaagtctttaaattctgagaaactcagtgccggggacattggtagattttgcctgtcctgcatacaccctctcttctgtggacagcacctcattttaatttggggaattgctcctccccaaattaaatacagtctcccaattatatacagtcttgggacctttagtgaaggttttctgcccaagtgaggccaatgggtactcttaaatcttggatgggctgatgctaatcacagtgggagttgattcaacctgatgacaaaaccctgtaatgactactcccgagtttccacttcctcagtgtcagagctgcatctctggttcttttctgtcctttctgggatcttgctcttcagtttttcattggaatctctaaggtaccctaacctttaaaaaaaaaaaacaaaaaacttttcttcttaagtcagcaaaaaaataagtttctgttgcctgcaaccagagaatcctaactggtagacttgtttacctttactttggtttctcacctaattctcactgttacctagtatgcaagtattaccaccatttaggtttctttctctctcctttcctttctttccttccttcctctctggaaggggaattctgcagctttcttcagtaagcaattccacagttgctgaaccctcacaaactgcactgattcctcctatgcctccctccccaacaccctcacccctctgcatcttattcatcccattactttgggcttggtggcctttggccattttaaaataagcaagtcttcccttgacctgaatctcccaatgctagatggttctctgctcttacagagaaatcagggagctgaatggcactttccttttttcagatcaaagcagatttgcccgatttcatttttaatgctgcttctgtacaagcagagactgagagaagactaaggcaggcaaaggtcagcctcactcttcagggatgaaggtggaatagagggagaatgagtccaagcaaagaaatggctctgaattttgcccaggagagggttttgatttacaaagcgagccccacctccctccctaacacccctggtgaatcatgtatcatggtccttgagcacatactgttgggactgaccctcccataatgacaaccaacttgacatatctttgccttgttctccagccacacccaacggtgttgccacagctagcataagctgctagccattcactctgtagactcaacatacttgcataggccccagcagacctccagcatctgttagtcacacagggactggaaggagctacaggttagaaggctggcggatcacctgcggtcaggagttcgagaccagcctgaccaacatagagaaaccccgtctctactaaaaatacaaaattagctgggcatggtggcgtacgcctgtaatcccagctactcgaggggctgaggcaggagaattgcttgaatctgggaggtggaggttgtggtgagccaagattgcgccattgcactccagcctgggcaacaagagcaaaactccatctcaaaaaaaaaaaaaaagaaaaggaaaaaagtaaaaagaaggcatgatacgaggcatgacaggccacagcaggacctttgtggggtctggaaaggagtggacctcaggatcacatcagcggattcccaaccctcccaaatctttctgcacccctcttttactgggtctgtaagcttttaggtgaacaaggcaatctgctattacctatgctctccactgttcaatgggtatgttcaacaacgtgaattatcaaatgcttttgggaggcttccctctaatgtctcttgctttcatgattattgtacacttccatgatttcaatgaataaaattcctgaaaaaagagcatttcactgggaagacgctcctgcatactcaagcttctgtttcactgccactgtttccttgggtggtactgattggtcagaatctcagataagctccaggagagcaagaaccacattttacccacagcacatggtggggattcaaattattgtttgttgagccaatatgttagaatgggagttttcctaaggctgttctatacactagctgacatttgcctttggagtcaatggctaaggtcatataagctcccactgagatgggcacatatctatctctgaactgcccccatgtcctcttgttagaaaggtacaaggaggggagatagattacttttccagcaactggtacccatatttggaacagtccctgtggttctgggggtgacagcaggccattgtgatgcaacaccagtactggctgtggagactggaacccttgggacaagagaatcagatttccacaactctcacaatgtattgacctctataatgttttaataaaaagagacactggacttggccagttagaaagtttcctggtttagtttcatagtatgatgacagcagcatggaaggaaccccaaagctaccaggaaccattttgcacagctctggaaagaagtccagcagagtgaatgacatggtacgaagacagaaaacagggggcaacctagtctggatggctgcaattgttcctgagattctgaatctacccggcaaggattcacccaatcaaaggagccattgatcagaatcttcagcaattataatttgagaaatcatattcgaattattttttaatggaagaaagaatatttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccaccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctatttgtcttcttatttactgtatctgtctgtctacagttcttcatatctttataaagatcggttattggggcctgtgtttccttctgactagaatcgctaccagatgatccttcctggtgatatgttgatgatttgctaatttatggcttttaaaatctaggaatccaaagacattgctgaggggttcaggctggggaagtcacgtggctcatgcaatgagggctgaatggctacttgatgagggatctaagtctgtgtaggatgcaaagcttcagtcacatttcgaccagagccatgtctgcaatagagaaatcgtaaatgacattttataggaaacacccctcatgagagcagtccgccccttgcaggcgaggaaaagtgagaatagctgttgcccaagacacaagtaaacatggaaagaaaaggcctgtggatcggcccaagtcagtataacatgaaatcatctcaaatccgattcccaagtgctagaggccatgccttcccagaaagagtcgagagggaaatggtgttgtagcaagactctctcagaaccaagagaagaggtttcaataagccctgatattggacttcccaaccacttaggtggccaaatagtacgatgtgtagctcagaaaagctgtggtatagttggagatttttatggatgtgtagaaatgcatctgtccccagtgcctggtagcaagccctcagtaaacacatgtggaatggatggacatgaaggcatgactcgtgttaattcctttaaggtagggtaggctatggggccatagattaaatgagtctttgtaaataaatgatccatgctctggcacactagacaatttaaaattccaaatcctttagaaatcagtctagaaccctggtggacaagacatgagtgtggtggaggaaatggagtggaattccacgttgatacaagacagccaggcaggagggaatagtgtgcgctctcaggaaggaacaaaggttctgagtgagaaggagagtccaaattctgatataaggaaagacacagagtttaaaaataacccaataatcaggaagcagggaagatacgcaggatgccatctcccgataagtcaagcaagcactgctcaggcaggttggggtctgagcgagcaatcagtttttaagacttcctctagtggaggtagaactgaagacctatgtttgcaagtggggcttgcataacctggattttaaaagcaagagtgttagctcccccagcttagtgggtaatgcaagctgggtcaaggtcattgaacaagcgttagttagcatctcctcctctgaggtgtcgcttccttggactactttatccagtgtaactaatccctgtttttctcagttgcagaatcttagtcttttctggttttgcagcacacattaaaaatgtgtaattggcatttgctttagttgtacccttgctcagtgcttgcaacctccttgagactgtaaactccaggaggacaggttccgagggtagtttgttcgccaatgaaccctgagcacccaacaaaacccagcatcatgcctgatgcataacacagagaatgcctgcctgccgagtgagtgaatgaaccgatggagaggggccacaggaatggacagtgaggcaggtcactaactgtgctgggctgtttttagttcttgaattttgttctcaactattgaatactcaattatttcttctaaagtatggaatcctctttaaaatatgagcatttacaataaagaagataattaagtactctagtttcatatttaaatagaaaagcatgacaaactgtccccatctctctgaatgtaaggctctttccaatgtggagaccacatccgaggttgaaggcagacagccctaactccctccagcgggatacaggctcctgagggtgaatattccaagtcaaagctatgaaacaaacacacagaatgcaccctgcagaactggtcacgtggggctctactgtgcctttcactgataaggaagaaaccacctccagatactgctctgtgctgtgcggcagactaactaaggagtgaaagggaacaggtggttccatctgcaagggtatagaaggctctgcaggtgagatctgcccagcagggaagtccaagtttagcagatcactacaattctccatggaactacctttaaaggatggagccaggaaggggaagaaaatgttgaaatccacaaaaaaggcacaattctcactttaggtgtggttcatctgtctgtccttgagagcctttcattgctagaagtgttcaagagggaattagaattctagtctaaccaaatgggaaaaataaaggaaggaatggttttgtcccctctccatctttttcccctcaatcctggggccaggacccttaggggtagtgggtgggcaggaggggagaggagacagccccaaagtgaagctcatgcctttctcttcctctccatcatgagcacggtactctggctccccttatacggaaaggtggaggaagatacaaacaataggagatcactgagtttagagcagaatggagtctcaagagatgacatggagaggcagcaggacgcagggaagcaggctgtccaggttcaaaccccagcccaactctttactagctgcgtgatgtcaggcaagttacttaacctccctgttcctcagtttcttcactcattccaaatggagatgatggtaatacctttctcacaggatcaatgtgaggattctgaaatatgcaaatatttgtaggtattactattgccagagaaggcagtcctggggctttaggctgcactgattcacattctcatttcaggaagtgtgtggcactcctgtctctataggcaaatgttccaagagaagccacagcatttaagtttcacaggcagctttcttgaattggagcaagagacgggttagtccatgacaactattccccaaaccagaatggcggctcagcagcttcatcctgaggaccttccttcaagttaattacactcactttcctctcccaccttggctacatctagtctttcatgactcattcccctctcgtgtgccctgtcagcatttggctaccaggaatcagtagaataatccaaacccatcccattctctctgtcccaaacacctgggcctaggattgcctcaaacttgagtcactcaagtcccaacatgggaaacacaaggtctgggtggctcccggctggactccctctaacaagggggttacagcagatggattcctctctgtgactgattattttccatggcccttggccatgtgaccttggaccacgatcttgtcagttctcataaactaaccaggagtggaatgaatcacactcagggaggagacctctgggggaaactgcaaggggctgtgagagggaggagagagctggggatcccaaaggccatgggagcgtcaccagccctcaggccttccctgtctctaagcagctttgaccttacacaaaggaaaggaggaggaggcagtggccttgggaggcaggctgggctgcaggagggctcccttatgaataagatttagggtatcagcccaagagcccagagagctctaatccctccaactcagagagattacctgcctcagctactcactgaacccttggttgtggacacccaaacccctattcttagatgctccaatccatcataacatacatgaaatagccaacacacacgcacatgtgcacaattacccatacctactgcagggactgggtatccttcaggaggtgatgaaaatgttgggtaaggcactctaggcccttgaaatagtgttgatggtgaagaggctttgagaatgctacttgaaatgtttatattatgccaaacacattgattaaaactgaaaatgaaatgccaatgaaatcttcatattctcaaatatcctgaatttgggtgttgtacaaacaaaaccctgatcttctctgcctaaattttgtactttaaataatctttgaatttcaaagttttatgtctctgtagctttagatcatgagttaccttgagttctctgacaagttaatatattgttagagaaatcatttctgaataaaatatgcacaagtaaacaaatcccttaactatgtatacattctaatttctttctgggcatttatttgattgggtcctggggagcagagaacatgtatgtgtgtgtccatgggcagagcacatggacttatgcatacacaaaaactcagagcacagcacactgttttaagagtctgaactttatctttcaacaaagtttagctgctttccttttgcaaatgcatttaattttatctggaaactttttgacgttagaaatagaacaactgtagtttctcattatgtttgctgccagaatccatgcttggttgctcaactaaagaccttatattgctaattactaccacatgcccatatcccaagcgaaagaaaacttattgattctgacagcccattctctcaacactgaattccaaatgaaaactcaaaatttggccaaacataacatttcatcaatcttgttttactgactggaaaaacaacatcaaacaaagggtgctaatggccctttattaccgtgcctttcccaagcttatattttctgatgaaagatctaagtgaccaaaggccttctttaaactacttagtaattagcttttgaaccaggaaacaatgcataaagtagtgaacaggcccggtgctgatgacaggacggactctgtgtctgcagggtcaggaacagtggggacccaaaaagaacattaaaagcaaagtgcattttcataaacggagaagaaaaaaaagagaaagagagagagagagagaaaaccaggctaaaagcggtgataaaagattacagagccagaacagagtggcaggaagtctgtgatctgaagtcatcagcacctgaaagtttgagtggaactgccagggtgaaagatgaccggatcggactgggggcagtgagtgagtgccgggctgagagccccatctgggtcagctggcaccgaaagctgccggcctccagcccacccaccagctcacccacatttgactaggaaaattatttcattaaaaaaaaaaaatcacctggaatgaaagtcaagaaatattttcaacttagccttcagggcaattgattttattgacttcttggggcagtgattgggaaatgctggcggagacgtcagaagatagggaggccataaagagagccccaggccctcagaatgccttctgctttatggagacctgtccacaccttcaaggcaaaatgaattgagatgctgttttcctcttggcatgggatacatgaccactgggaatctttggacttacttggccttttggatccaaccaatggcccagaaatcagaacagcttggttctaacctcatccagggctgttaagataatattgaggggagggctccattagagggaagatggagggatgtgctgcctcccggaaaagacgccaactggcctcctctggcccactgtcctttgtgcctttgaaaggaaacgggtgtcctgtgggtagttcaagaaaatgagcccttttgtccacctcctcatttcctgtgcagaggcctggacacctgagctcaggaagcactggactcactgaccaaaggggagggtccactctgtcccacacggctgactgtcaaaaagagaaggcagcagtggagggaaatacaatgctcccagtctgattttatttcctcttaaaaaaacaaaagaagctctttaagagttcatttgaaacagaacgagaagggaaaacaaaacaaaacaaaacagttccatgataggaacgtccatgactgggaagaggcatgagtgatgaaagttttctgtgtcctgatccggatggtaggatgatagtgactgggtgtgtacataggtacaagttcctcactttatatgttaaagatgtgtacatttaactctatgtaagttatacctcaaaaccaaaaacaaacaaaggtgactactccagaaaaagctttaaaaaaataaataaaggatggctgctgccagccccctctcccccatggcattctcctcttgaggttgtaaggtactgccctctacttaggaaaaaaccttggggtctctattgaacctgcacattgatatcgagagtgataaagtgatctgagcacacactaaaatagttcccgagaagaaagcattcacatttgggaagccaaacaaaagatttggcaggaatagcatgtagtaccctaaactaccagaaatatactatttcttgcccggaaggaatttcagctgagtaatgagtccctttgaggataagatcggtgcctcctggatgaagaggagaactgggttcccagtggccgcagtgcctttgcagtaggccagatgacctggatctgccacccaaggacttctctgccagagtcttatcctgtgttcttgctacacacaaaccaccataggagggcatcatactagtttgagggaccagaattttatcacatagccagatgatggaagaatgaacgagttttgtttacttgttaggggtcagaagagaaaatatgggcccagttataaatggactcctttcaggataaattcattacatctcttggaatttgtgaatgggagttggtccaagcgtggcaacgtcctcgggtcacctctgacatcacaccccatgcagaaactgggccttccctcacagaagcacccggtggggttggggaggggcagaattcagatggcacctccacagggactcctgaaagtcactcaaccacatcttttctgatgcaactgacttactttctgcctccatgtttgttaaaagtcccgccgaatttattccgactcaggatgagagcagcaatttcgggcacgtagcgggcaaacattgcctacatgcatgaaacaaagaaacaagagccaaaaaaaaaaaaaaatggcatgcagagaggattctaccgcagcagaggcagcaaaacctcttggcatacttactttcttccactaaccgcactataggagcccccgtatttcttgcggtttcctattaactctatgatttcagggacgtagctggcaaacatggcctgagaagataggagacagaagagagactaaaaagacaggccaaagaaaaggggggacctgttcagagggtgggggcactaagatctgaaaacacaaaaggattaggcctgcaaaggtatatattgatatgttggatcataaaaaactaaaagcacgaagagagcaagctcccagaaatacacaagacaaacaaacattggccaccttgacaactaaagaacaaaaaaaaatcacagtcgagaaaaatacaaaggcgacaggaataaataaggtgatatctagttcttcttgctgaagaaaaataggcaagagggggacatgctagtgaaactaaacacacacagacacatgtgtgcatgcacagacacacacagtttcgcaagagaagatcttcctttgtcattaaaattcagaggagaatcaatgcttttatgagtgacaaaagaaaataaacaccaaaagattaaaaactacatttttctattaaaaaaaaaaaaacactgaaaagctcaaaagggaaatttaggaaatcacctgggaggagaagatagcaaggagaaacacaaatctgccatgttttgtccaacaaacatctggcctgtggctggctggatgggtctttttatctataggcacctcacggatgctgtagaaatgcttgcgtgaatgtacacatgcatgtgcacatttatatacatttttaaaatgtataggccctatgcatacaaaacagagagaggtgtatgcatcactacatataaatgtgcgcacggtgtacatacatgaaagctgtgtatggattaggattttaatcactcgcttcataaatggcaaaaaaaaatctaaacttaaaatgagctactttgaaagacaaaatgcagcaactgccaacgtgtggccagaaatcccctcgatttacattagaaggggtggtttagtgcaacataaagagctgcgtagacttttaaaaagcaaacagtgaaactttcttagaagaaaggagcaaaaataccccatgtgtccgctgcagaatggagtgagctgtttgcaaaactgcactctgctcacatggggatgtccgcctggacaagactaaggtgctctctctcctttgatgtagggacccttctctttagggcaggccccagccacagtgtttgttggaagttaggggaggaacataaaggggaagggagagctcttgaaaccgcaaactgtctctacaaagtatcgacagcttctaccagaggcaggtgacagccactgtccttgtagcataccagatgctgagttacattgctaaggggtagacactctcccttattaacagcatcacttttcttaagacaattaggtttgctcctggctaaatggctgtccccgacaagggcaatgtgcctggatctatgggacaagtgtaatacaccaagaattatgcagaaaagtcaccatcgtgtttggatttacttagcctgattgtaacgttaaggcttgcttctagtgcagaatacagtctaaaatacaaagctttaaggaaatgtatcatggaaaatattaacagccatcaaaatcaacatcataataaagatttttttttaccagtcccccgaggatgaagaagaccatgaagaggcgcccaagtgtggtttttgcataaacatccccataaccaacggtggacattgtgaccatgagtaaatagacacattcccagtaggtgagagcctggttgttttggaaattttcccatgggtcccctgaattctccacctaaagcaaatgggacaggggagaaaaaagaaaaacatgctattgaagtgtatacatgcaataaacgcggaagctcggcactctcgaaggccacttgctactgcacaccactctccacacgagatgtgtggttcccgggctgagttctgtgagtcaggatgcagagctcctgagcaggacacagagaaagtggagaagcagctgcaggagatgtcttcctggctgattgagacagagagggaaagcaagaagggaaatatctctaggccttttctcttcttctggtaaaatgtgggaagccagctaaaattcagggcattgcctctggccaggttttagagcactctcttcaaggaaagagccagagattccgtccctgaccttcctcaatgggtttctaaggcccagatggcctggatctgcctctcccacagaaattctaaacacttccgtagggggctgcctccttccatcagtttatccaaagagtatatatgggccctgcttatttctgattcaaacagcatctctggaatctggccctgctctccctcctttgcaaattggcaatggtggtcccagccttgaggctgctggaatcttcacaggggcatggaaagtgagctcatgagaacagcttgcactggcacagcccgttagatcaagggctggcaaactttttcagttttgtgggcgacacaggtcctgttcaactctgcagaggcaaaacttcaacaaatgggtgtggctggatttggagagctttggcccgagactgcagtttccccactttcctgtccttccatcatatttgatctgccaacaaggctagtaggtgggcaggaaaggtactttagatactctcaggagagagggagctgcgggcccaattttactcaaatatgcctgtgatccacccacagggcctgtagacggtggcccccaggcctccacctctgcctctgcaaaatgtttccagggcctggcctctttcacacatcagtttgtcctcaatgtgccattttcacaaaagtttcctggtgaacctgaagggacttcactaatacccgtagtaaggtggggtcatcatcttattaaagacaactatctcctccacatatgtgatttgggtgcttcgtgcttggttacagcaagaattagggtgattaaggttgattttggccatgaatcccatcagcattaagggctgggcaggagactctagatctggtgactacgtgaggccccatgccccaaccactgccatcccaggcctgtcttcctttgggtgataattacctaaatcccaagtgtgggtagctaagcgcgtccttctatcccttatgcaaatagaggctcagccactggtggtcaactttatccaaagtctcagagctagacgaggctccttccagttgtaacagtctatgtttgcatgaaacacacttcccacaatggctgtgctctctaaaagcagggggaaagtctgccttcgggtggtgtgaggggcttgacttaatacaaggctttcaaagagtcactaatgaaaaagaatgaacatttttgaggtacaaatcagacaaaataatcaaaggtggcttttcgtaaggcggaagtggaaagaaattgagggatctgaatttgttgtttactaggaggtgtgggtccaacttccaaccttgtccccagaccttttccaggtgtttgcttaggaagcactgccatcttgtggcttactatagttattgcagacagaaggaaaatctaccaaagcccccatgacaataccaatgagcaatgaactgaaaaatgcaggttaatagtgcaaacattactcaccatttggaactagtttggggtaaaaaggttggaaacccagacaattgtgtggttgcttcccatcttcctgtctacaaccgaggtgaagttaatttccagcaagataaattttaggtaataaaatgactcagagagggtcttgttgcaggcaagcgagagcagaagggtcttcaaggttactcaccaaatggatgaacccggctgcagtcagccacgtgctgataaatatggagagcagattcaccagcttgatggaattactgtgcaagagacaacaagcaaaatccccacgttaccaagggaaggccctgctggggctgccttacagggtaacagcacccgcttagcaggagaggctgccacatctaactcccaaccatttctccattataagggaattctggaaggtggaggaagctgctgggatgaaggtcaggacagagcctagaggaacaaatttaactttggtaaaaattaacttttatttaaaaaactcttcaaatctacagaaaagtggaaagaacagtataatgaacacttgtacgctcttcatttagactgaccaattattaacattttaccacgggtgctttatctccctacatgctttttctcttatcccccccgcccttttttcttctcttcttcttgccatgtacatatatatatatatatatttgctaaaccatttaccaataaatcagagacatcatggcacaagccctaaatactttagcacccaactcctaagaagaagggcattgcacagcataatcacaataccattgcacgcctcagaaaattaaaacataaaaattcagtaatgctatttaatatgcagaccttatttaaatatctccagttgccccaaaattatgtttattgatttttttttattttccccccagacccaagtttcatgcactgcatttggctgttaggtggcttaaatccaactgtcaggaaacaaggacagagagtaaatattttaggctttacaggccatatagacattgtcacaaatactcaactctgtcactgtggcttcagagcagcttttggacatcatgtacaggaatagatatggctttgttccaataaaactttatttacaaaaacaggcagccggcatgggctatagtttgccaatcccagcttcagtcccttctaatgtataattgacaccactcctttgtaatgacattaaattttgtgtgaacctaggttgtcttctataatgttctatattctggatcctgtttatttacttatttatttttattttattttttattttttgagacgaggtctgactctgtcacccaggctggagtgcagtggcacggtcttggctcactgcaacctctgcctgccaggttcaagcaattctcctgccttagcctcccgagtagctgggattacaggcacccgccaccacgcccagctaatttttgtatttttagtagagatggagtttcaccatgttggccaggctgatctcgaactcttgacctcaggtgatctgcccgccttggcctcccaaagtgctaggattacaggtgtgatccaccgcgcccagcccagtttattttttaaataaatgttattgtgtatgtttgaggtttacaacatgatattacctaccatctcacatagttacgtttttgtgtgtgacaagagcagctaaaatctacatatttaacaaaaatcccaaataccatacaattttattagcaatagtcctcatgttgtacattagacctctagacttgatcatcctacatagctccctacttaagtatttctgttaagaatctcttcggggatggcatcacatcaggatatcccagcccaatgactagctccatccatgtggctaaggcagaaatgctaatgtctccactgagaggtgcccatttccctttgtaatgaatatgccaccttgagtgaggccccgagactgcaggaatatcctgctccccaaaaaccttatacctaatagctttagcattcactggtgttccttgagtggatcaactggaccttatgacattttgaggtccctaagagctgaggccttgtctgtctggattccaggagccctgggtccctggagcatagcagacccgtgactctgcactgagtgcactggtatctgcccctgctctctttctaaactgcatcctgttcagtcccactggggtatacctgaacgctgctgtcagcaggtcacttcactgtccaaaggcttcttgttgactaaaagatgacattcaaactctctccttccattgtcaacaccttgtgaagtcccagtctctcccaccacccctctttcacataaactcttgaaactgccatgccagctaaacctatttactatagctattgtttacactatttactcaacttgaaagcccttcccatctagtcaaatttccccattcttcaaagcccagttcaatccctactgcttccttaaagtcgttccatccatctgcaagacaaagtgactttccccggctctcaactccagccattcattggtaattgatcctactgacttaagatgtcttttgtaaagttttaggttgctatttgactcttgtgttccttgctgcatcttgcagaaaagaactctcttttctagctcttgcattttcccagtagtggcttaatgcagcctacagggttgcccaacccattagttttggtcagttcatctctgttatgactgccctctcttacctctcttttggagaaccaatgatttaaattctaggcatttaagatcacagtaatagtttcagctagcttgtttacagttctttcccagtgctcaccacatgtgccaccatcctaagtgctttaggatcacctgtgctttatgtatactaagtcatttaatgctcataacaacaatctttcttcttctatggaagagcacagaggaatccatagtcttagtttttccagagttgattctgacagttcatggaaagaataaacagattcaactttgtgggtgagactgatatttcaaaatgtgtggaacaactttcttctggctcgaaaacttggaaaaacagccaaaatgtccattctgtctctcttggtcatttctagagttaccagattataataattgccaatatttattgagcccttattatgtgttagatgttgtgttaagcagaattctctcctgcctgtaccttgtaagtcctctaaggtgtgctcccacattggagggtaagaaatagatgaagaactgatagccggcgacaaagggaggcctcttagggaggtgtgtgttgttcattttctcagggtatcgttaaataccaagtggcttcacttacatactcctggattcttgggacctgaacacagcagtgtcccaccaacaaccatgtagagtcctcttgagatattaaacctatttagagtctgagtctccttggtgctttggaaaaatgacctaaatatggtgattactaaactctaaatgatggttacagtgatattagtagtgcgttagggagctcttgccatatgcagaacatttaatcattgttgctaaaacagtccatgtttagctctgaaatctgattatttttatgacatcagtattatcacagatccctaggtttaggaatttgctttctaaatgaaactgtatgaccacacatctgaaagctacaagcaaaagatgcaaggttaacccctggtgggcattctccacagtctgaaatgtgaaccttgccaggttaagtagggctccttgggaagaaagagtgaggcacgccaggagcagggctgtgtgctctgcatagcaaaggttatatatctctgtgtggagatagtcatagccttcctggtcaagcccagggatctgggccaaacacgaagctaccagcggttagaatgatttgaaccattcagattctagcctgcttcctaagctttgagggagattatgatcttatcatcaacacctgatccaactaaagtcaatcattctcatgttgcctatacaattcctgagtctccatcccatgagttctaattcacatcgatggacacagtgaatcatgataggtcaggcacaggattcttgtagattagagacctcttccaagaaactgtggatgctgcaagagaaggtctggctccagagattacagctgtaaacccagagcttctggggcctcctttgtcctctatatgtttaacaagacatgtttcagttaacacagaaaatgccatgcactttgtacaaagaagtgtacgtttgtccctgttctgcttgtctctaatttttctctttgtttctggtactgccaggtgctgctggccttgtttgttttactgctctctttgctggacagatgtaaaatacccaccccctaaaaagttaactggactgcaccacactaacataaatggtctgaatgacaacatgagtggaacaaagtgaaattctgccaattcaatcccttaattatctctagatcccttcttctttctctgccccaatttgcactgcctaaggccatgccctaatacctcttccctggactactgcctcctaattggtcttatggtctatgaggtctttgatgcttcaaccccattctctatacaactgttggaatagtggatctttctaaaatgtcagtctaaccacatttcctctcctgattaaaatccttcaacagctctcatttgttctcagtaaagtccatgaatctaagaacctgcatgatttggcctctccctgcacatctcttgcagtctccatatagaatactcttctttacaaactttatcttggagccatttctaagttcatgtcagtagtaatgttttagtttcaaaaacgcctcccaaaaccatattggttaggtacacgatgactcatgcatatcatggaatgctatgtgagaaacaaaaggtgacatagtagatgtaatcattatctcaaagtagtgtgatgtggaggcaattttactttatcctatgtgattttgtgtgttgttgcaatgtttaccatgaacatattttcaaaattagaggaaacaggctgggcacagtggctcacacctgtaatcccagcactttgggaggccaaagtgggcagatcacctgaggtcaaaagttcgagaccagcgtggccaacacggtgaaaccctgtctctactaaaaatacaaaaagtagccaggtgtggtggcaggcacctgtaatcccagctactcgggaggctgaggcaggagaatggcttgaaccctggagacggaggttgcagtgagctgagatcacgcccagcctggacaacagagcaagagtctatctcaaaaaaaaaaaaaaaaaaaaaaaaaagaaaagaaaagaaaagaaaaattagaggaaacaataaggaaattcccattttggaaaaaattgctgagtgatccatgttttagtcatcaatatttaccacagtcaatgagatgtggaattacagcctttaaacacagctgctgactttcctctgacagtagaataagtgttctagcacctgtgtgttagatctccagtttgcagggcaactgagaaactgccaaaacctcagatagtgagagggagtctccttgtctcccctttaattggccgtttcaggctatggagtattctaggccccctatgggcttgcagtttgggaaagggccctgatgctggtcacataattgtgatttgcccatttcatcccatgcactttaattttccttctgctgcattcttaattctttatcaatctttctgcccaccttatgcttctctgccttatttctttcagctcttggcccagtgaggcagccaaagtactggaaatgaaacagcaactccaaatcattatttcaaattgcattgcaaagcctccatccctgcctaatgccacagattggcaggaattcaccgccaaagagagccagacaaaatctccctaaagacgattacatgggtcccccaacccacccttctggaaggaccgctatgaaagcagcagagtatggaagagtcacaggagaatcgctcaaaagtccaaaaccctacaaaagccaaggctgcactttctctgggacagaactttgggatccacacttggggatgcccaaaaggaaggagccaagattagccaggctggcacctggagagagaatggcctcagagagttgtcctaaagcttctagatttcttacaattacatgacgtttgcttctgtgcctggtgacctggcctttcctaccctcttaacctcatcctcctctttccatcacagaacgcttaatgtccaggagtgcagaattacccaaagtttccccaagtgttatgctctcacaccagtgtgctgttagcatcttccttgattagaagtcaacccccaccctacccctcacatgcccagccccatgaggatgacacttttttctacaaggcttacctaaaagtaaccttctcctcgaaaagatccttgactgccctgcaactcaggctaagcccagcttagttactcccctctcaacccctgggcatgctgacatcagcattaaccacaccgtcaggtggcctggccccctacgcagcaagttctctgacagcaggactcctagcatgcaccttgctgctgataccaatgggtgctcactccaggcttgctgaattatctcaaccatctggttatgaccataagtgaaaggaactctgaaaacccaggttgtgggtttgtggcaaaaagcaccctctaacaacaagagtttcatatagtgggaagtggggtgctggaaaaaggctgttttggggcccggatggcagatgcccagacagccttccaccccgtgactcttccctagggccattctctccctcgtcccctggctggctgcttcagcttccccgctctgcactgagagaggcagcactgagtgcagttggcaggtgagctgacaccagggatcccacagccacttcccgcatccaaaggaaagagaggtgagtgtcctagcagaaagtcagaaaaagatattcagatggtccatcattttctcaagttctaaaacggtccagggagtagacagtattcctcagagcaatggaaccttctcaaaatgctggcatcagagaataaaaatccccctaacatatgatgtaattgtgaaacagggagagacagacactacccaatgttagagagtgtcacaaaacaccatccctaccaaaaaagtaagtgtctcttaaggacaaggctctatgcttggtgctgggtactcacgcgttccatctttaaaacacagtctagtggagtgaatctgacatacgtaaatattggcgagatgctagcttcattgatcgtttacatttcaaaagtaatatgattctagcacatagaagaataattaaaaggcagaaatcaaggttattggcaatcagaaaaacatgaagaaatacaatattcactgtatgtgaataatattacattattgctaataaacagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcaggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaacctcttttattagtttattcatcaagacagccttggtttcaggccagctctgcaagccggcaggtcatcaggaaagggatcctctgggggcttttcctcctggtccagttgtgttttccagatcataacgcagttaacagaagtattcatggtgcattcggcaggaggtttgtaggttttcccccaaaaggcaattcacagagaaagccccaagggctatacggatataaagtgaacatctaaaatgtgctttgaaatgaaatgattttctgtttgccgtatgaggtttgtgattgcctctcacagcattgcttctattgcctttacgactgggttcaatttcttatttagtgatgtaataaaggggcgatttagaatctggcagcaaggacttcccaatcaatgagcaaatctatccctcattcactgtgcacctttccccttgacaccgtggctcttatctgggcaaccccactgggcacacagatatcagctatgtgtccctaaaagtgtccctacttccctgcatgcacagctatttctctcttttcaccacatagttccctggccctgcagaagagagcaactcaaaccctactctggttttctctccctctctgtgttagatcactctttctgtgaataatataactattaataatgtcattgtgatgaaagcaagcacacctgatatttgcaacttggcataggggactggaatgaaaaaaatatgacgaagaacatcttaccttgttttaagaatattcagaaactgcaaaatttctgaaaactgtatcagtctcagagctcttaaaaatctcaaacctggaaaaaagaatgaaatagagatgcattattttcaatgtgtgattttaatgttcacagtctgccatttgatttacagttcccaagggtcgaagggatgggaagttcttgcagaagataaaccagctggtacctcagacatattccttcattctgattcttgactggtttaatctcgactgggaaatggactttctctttataaaggtggcctgtttggaacctctttagaggaagggctcatggggagaagccaggttaatgagacttttcatttggtgatctctgattgaaagcactgtttctaagttacctagttatctggcaggattttgtctctgaaaaatcctaggaattgtgatagctcagggtaacccttgtgctaagagcagattgagaataaatcggataaccttatgtctttgatggattttattttttatctttatcttcagccctgataaaatgaagagtacagcccacagtgttatctgttttctacaaacttctatattttcctcccaataaaaaaaaaaaaaagatcagtgagatatcacaccccacaacttcaggattcaaaatttatatagttccccttttattaagtgttaagataaatggtttgtcctttctaaatcaacaacctctcttgaatgaaaaagaagcatcagtgtttaggtggcagaagagagatggagaaggaaaacacatcaaggacattttaaaaatgcaaattattatgttttaatagctaagagtgaattatatttctgttcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcacagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataaaaaggctcacggccaaaagcacagttgtaactgagctgatgaaaggctgacttagcaccgctgaaaaccgaccacggcgcagagtacaaaactaagaagtcacctcagaaagcagagaaaatatgagaaagggagaaaaaaaaaagatgaaacttcagaaaatagaaacacagtagaaatcacagagatccaacccatggataaaatgtgttggccaaagggaagtcaaaacatcacattgatcataagcaaaggccaggacataacagaaaagaacttttgagatatgaaaaaatgactggagactaaaaggtaaaatgaaggatcagttcttagagaccaatgccaagaagcatctggcttttcattttcacatttcaagtattaaaatcaagcaataaaaataaaccaccagtgttgatggggttatttaccgttaatgtaactaagatcattatatttaacaaaaagtgttggccgggcacggtggctcatgcctgtaatcccagcactttgggaggccgaggcgggaggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgtacccgggaggcggagcttgcagtaagccgagatcgcgccactgcactccagcctgggcgacagagcgagactccgtctcaaaaaaaaaaaaaaaaaaaaaaaaaaaaaaaaaaaagtgttaaacagcaattgggcaattttcagaatttttagacaaacagaatttgacccaagatttttatacccagtcaagtggttgttcaagaataaaagtaacaaaaaaaatttcaaattctaaggtctcaaaaaatacattgtttgctcagtgtgtgcataaagtttccaaagaggttcacaagacttgctaaatcagaatgggagggggcaagggctggaaattaaatttataacagactctactgctggtcctaaccttccagcccaacctagactgttatctcataccagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaatatgtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaacattatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgccacatttgagtgagttacacaaatatagtagaataaaagcttttcttttaattaaggtgcatgaaagtaagggcaggaaagaaatgaatgcagaggccacaaggtcctatactcttgctagacacaaactgcagatctagctctgagcaccttcttaacaaaagcaagcaggcagacaggataagatcaatagtgtatacatatgagagaaaaacaaactggcttgcaggagaatcatttatttttcccaacatggagaccagagggaaatatctccttgcaaaagggacccagggtgatgcaggagcaagacccctgtgggctgaacaagggtggcctttgcttatttgactgcctcatactgggcatttttatggcactgagtttcactaatgcaaatgagccaatgaagttctccataggttaaaaaagtcagtctacatttcatcctcagatcaagccagactatctggagaaatggttggtctttcaggaatcattcacaatagcttccgtattagtccgttctcactctgctaataaagacatacccgagactgggtaatttataaaggaaagaggtttaattgactcaattccacagggctggagaagcctcaggaaacttacagtcatggcagaaggggaagcaaacacatcctacttcacatggtggcaggaaggagaagtgttgagcataagagggaaaagccccttataaaaccatcagatttcgtgagaactcactatcacgagaacagcagcatgggggtaactgcccccatgattcaattaccttccacagggcccctcctacaacataggggtattatgggaactacaattcaagatgagatttgggtagggacacagccaaaccatatcagcttcctaaccgctttctgccctggaccccttgtgttctctgctcagaagcctccaatgccacccattccacacagagtaaaagtcaaagtctttcaaaggcctaaagcaacaccatcccaccaccagcactatctccttttggatctgatggcttcctactgtcactcctactactgtccgctgatctggcagatgtcttcagtgacacttgaacacacaggtatgctactgccccagggcctctgcacatgcagcctctctgcctggaatgctgtttgccagatgcccacatggcatactccctcacctcctttgggttcttactcaatgtcccttgatcagcgtgactttccctggctacccgacctaaacatgcaactcctcccacaccacccgtgcaactccctatcctctttcctgcttcacttttctcctcagcatgaagcactagcacctcggttatgtggttactttctgccttcctctctttagcatcagctctatgaggggaggagctgatgtctgttttgttcagggctatatttccagcattgaacatagtgtctggcataaggtgaaggctcaataaatccttgtttgaactgaatgagtgaatcaaagttttgagaaataattagacggcggagttaaaggttagataatccacattcagaattctgagactatatgttgcctactaaagggaaaagccagaagccctgcggggtcccctgagagaggtcagggctgcactcttgggaagtagaaagtagcctcatcagggaaaagccttaacgaatgaccactctggctatacccagaaagagcccagaagactacagacagcgacttcaggctaagagaggagaccaagataagagaggtgagagggggaactctttggtgacaattattcatcttctctattttataatatcttttattatttttattctataaaatctctgaaataaatgattttctaaggtaacacaaaatagctataatagagttgtgaagaagaaaatgtgtatataccaaaagccaggaattacatgccctccccaaaagcttccaggttcagagagttttacaagtgagatttttacagtttcaaaaaatagtaacttctctatctattctctattatatgatcaattcttaaaaatggacttatctgtgtttttccatgctctgtattggtttagaaagttggcattacctggacacaagttcccttgcattttttcttaaatggcaagcttatcacactaatgactaacaacaataatcctaaataaaatactagggtatcatatccaagactgcattaaatgaataaaagacatgagctatagcagatgctgtagggtacagcccaaatcccctcttcagggaccttatttgtcctgggctcttgaagagtgacctgctaaaggctcagagctagtcccttcatgagaactgccctctgctacaaggagctgcctcacctggggctacatcccctgtcagtggtggtgccccccacccccccaccccccccccaccaccacacacaaatgctggctgatgtagggacaaaggtcagctgccttgcctcaatttgggatactttttcctgtgggatgggttgaggcttcccaggcagctgcagccagcctgagttctccacccttattccctcacaggcatgggcattaaatcctaccctggtgatctgcataccagaagaccgagcattctaagagtccatgtgggcatactggaggcactcagtaaatggtaatttcatcatatgaagaattacaatagcgtaggagtgtacacacgccacagaaaagtcatcaaactggactagaaagcccagaaacacacacacaaacacacacacacacacacacacacacacacacacacacacacacacacagagtacatatagtgttactattattttaaattactggtgaaatgatgatgttgacaatgacattaatctattattattgatgatatctagtatgtttatttacttacacacactaaaacttctaactatatcttttttaaaaaatacgtacacagaagaaaatagctaaggagacacaaatgagacagtgtatccagcatagtttgaaagcaacagagccaagtttcaccacaaatgtgacaaactccacaaagcccaagcttctagccactgccctgtacagacttcagccagtcatttccaattcagacattaggactcaagcacacactttcaagacttgtgatacatcttaccaacttgtcctcacaatttgcattcccttcagtatgcaaatgctcttttgcctgtattcccactggattgagtacagtgatagagaaaataggaaggaaggaaggaaggaaggaaagaaggcatgaaggcaagaagggagagaaggagagaaggcaggaaggcaggaaggcaggaggggaaagggagagaacgagggtaagaatcccaatttgaggtcgggcatggtggctcatgcctgttatcccagcactttgggaggctgaggtggactgatcacttgaggtcaggagttcgagaccagcctggccaacatggtaaaaccccgcctctaccaaaaatacaaaaaattaaccaagtgtggtggtatgtgcctgtaatcccagctacttgggaggctgaggcaggagaatcacttgaacctgggaggtggaagttgcagtgagccgagatctcgccactgcactccagcctgggctacagagtgagagtccatctcaaaaaaattaaaaatttaaaaattaaaaaaaaaatcctaatttgatagaccccaaataagagctcatggctgttttattttgcttttctatcttaacaaatgaagctaattattttttcatataattattagtcattttattttcttctctaaagtgctttagagtggcctttgccagtctgcctgtgtatttatcttaattgtagtaatacaattatgttctcatataaagaagattttgtataccatatattatctcccaccgttcgtcattcttctcaatttggcttaaagtatttttcctactgtcaaattttacttaaggtgggtttctttccccatgaattctaaaatatatcaatctttctaccatgttccctttttttaaaatttttttggccatccccatcatatagataatttttttttttttttttttactgcatctatttttttttctttgtacttttggggcactggttctggactttgactgtacatttaaatcacctgggaaacttttagaattgttgacacctgggtctcagcaccccctacctgcattctgatttaatgggcgtggggtacattcaggcagagggagtattaaggctccagagtgattctaatgagccatccaggttaagaagcattgcaaactttttctataaatgaacatatagtaaatattaataaatattttaggctgtcacaacgactcaactttgctgtaaataataggaaaacaaataggtgtgaccatattccagtaaaatgttattcatataaataggccatggacactaattttctacacttgctttggaggcatgggattcaaatccattgtgcacatgaatcacctggcatttgtaaacatccagattctgactcagtgggtctccgatggggcctgatactgtgcatttctaacaagctctaagctatcgtcaatgctgttggtcagaagaccacactttgggaaaacaaggctgcaaggcagtggtccccagatttctctgccattgcaatcacccgaggattttaaagcaatactgaggcctgcttcccaccagattcaacgggtctgggatacaagctgggcatcagaatttttataaattctgattcgagtgtgcagccaagtttgggaaccagtggttcagaatatattttcttttctctaacctttaatttgttaatctgttttgatgtatttatttattttggttaacagtgcaccaaaaggaccaagctttatttttctaatcaagaagattctaatgtacagccagatgatggatgaggatgagtccagtgtacagccaagtttgggaatcactgctttagagtatcttttattttctttttttaacctctaacttgttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataaaagattatttataaaacaaagcattcagcttaagattttgggggaaaagtagtcttgacaataggagaaagctgattttttagttcagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaactgttccataatacaaaacgagatctaaagctactaacttatattataaaataaacataaactgaggaccaaaaactgactctcaaagcacaaaaataaagtagaaatggccctcaacttacaatggttcaacttaatgattttctgacttttcagtggtgcaaaagtgatacctattcaccttaaaccatactctaagtattcacacaaccattctgtttttcactttcagtacagtattcaatacattacactaaattttcagcactttattataaaatatgctttgcgttagatgattttgcccaacagtaggtaatgtaagtgttctgagcatgtttaagatagggtaggctcagctgtgatgtttggtaggtgaggggtattaaatgcattctcaaacttaaaatattttcagtttatgatgggtttgtgaggatgtaactccatggttaaattgagaagcatctgtattctaatatcactaagatcatagatgccaaaattctgtatataataccaacataaattattcatcaatgaattaaaatgataatccagagcattctagttaaacatagcagatggatcacaatggtttatgtctgccccctctcaaaacttcactaaactaatacaaatgttgagggggtaggaaacagcagaatcccacaagaacaaaaagaatggaagaggagattacaacacagaacagacgaacacaaaatgtgggtagatactctgttagaaactgacttggcatacatatatatgtatttatttatatttatataaacatatacatatattttccatgtatatatttccataatgagaaagaaagacatatacacacacatatgtctatctccacaatgataaacagaatattaaaaatgtctttggtcaatacataaagactgaggttgatgggggggtggttgggatgcagagatcacagtgaagaagaaaacaaccatccaaaaggtgaaatgaagtggctgaccctgggaagaaggaggctgtgacaataacactgattgactggggtgccaaacaggagtagtcactacatggcagcaagtgcatacacttgaggtgttaaaatagagcaatatcctgagtaaactgtaactcttggaagaaacacactgtctctacagctgtaagaccagttaccgaatagaaacacacagtagcatatctcagtactccccagacaaactgcaacacacaaagacagcattcacatataggctaacagaagatctcaaatgcaaagataagcacaaaacaggccaagcacggtggctcatgcccgtcatctcagaactttgggaggctgagcaagactccatctccaaacaaaaaaacactgtcaagtacatctacatataaccacatggatgaatcacacaggcgtaacactgagagaacaaggcctgacacagagtcattctatataacccagttatatgaagttcaaaactgggcaaaactgatatatggtcaggagagtggttacctttgtggggtgtagtgactagaaggttgccaggagaagggactagggggtgacaggcaataatgactgtttcttgagctgagcgttggcttctcaaatgcattctcttcgtgaaaatttatccagctgttgccaggcacggtggctcatgcctgtaatcctagcactttgggaggctgaggcaggcggatcacttgaggtcaggagttcgagaccagcctggccaatatgatgaaaccccatctctactaaaaattcaaaaattagctgggcatggaggcaggcacctgtaatcccagctacttgggaggctgaggcaggagaatcgcttgaacccgggaggcaggggttgcagtgagctgagatcgcgccactgcactccaacctgggcaacagagcaagactcggtctcaaaaaaaaaaaaaaaaaagaaaagaaaagggaagaaaagaactaaagaattgccaaacatttgaggaaaggcaactttccttcaagaaatgcacatattacacttcaggccaactgacccttaaggatacaacattaacaaagcattaaacaaaaaatgctttagaaaaatatttgaaaaatataaagagttgtgaaaaactatctcaactcaaaaaatcaactaaatatcttagcaattaaaattttgaacatcaaaatcttaaaaggccagcttaatagaagaatgggcatagccacacagcaaagtagagggctgaactatcacacagccatcttcatacaaaggggcacaggaatgaaaagtgcaaaagaaaaactaagagacccagaaaacaggaataaagttttccacatccatgtaattgagctgccagaaggaaaaaatgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcaacaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaaattaaaatctctggaaataaatggaagatggaggtgtgaaggagagagggcaatgggaaaaagaaaggtgtgcagaaattcttgtcttgataggatacaatcaatcatatatattaacagaaaaaaattaaagtatgtgtatcaaaaccttaaggatataaattccatagcctagagaaaaaaaaaaggacaaaggaatttaatcaaatggagaaaagaaaaaaagaacaaaaacttcagcccatccaatgaaaagaaaaaaaaaataaaaggtatattaatcagaaaacatagttacaatagcaaaagagtccaaatatatttgtaatcataataaaattaaattaaaattactttcacctatggaaagacagagattcacatgatatgaaaacaacaacaataataaattccaggcgcatgctatttaaaagacatacactgcaaacaagacatacagaaaagttagaaatgaaagaatggaaattatgtgcctggcaaatgctgagaaaagaggaacaaatagagcaatgactatatcaaataaagtggcagctactgcaaaaagttatataaaaattatatataaacattatattaaaaagaataaaaagtaatatctcatattgataaaagaaacaatccacaaagaatgtgtaacaaaaaaaaactttatacacctaaaagtattcctttgagataaataaagcaaatatgacaagaatgcacaaatataggacatttaagtagcatttaatcccttgggatatattcgtatctatatgtatctgaatggatgggcagaaagacacacacatatattagtaaactaggaacacacattctttaataacagccatgagcagtctcaaaaactgaccacatattaggccacaaagaaatttcatcaaaatctaaaatgcaaaaatcatctaagtcacatttaccacaaagcaatagaataagaaagtaataagagcatggcaacaatgactaagcagtagagaaatagactctattttatcagaagaattttacagacaataaagaggtcatcacaaatcaaaaggaagacaggcatcatgcaatgatggacctcataccataatggaaataagtttgagatgaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgtgcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcaggagatcgagaccatcctggctaatacggtgaaaccccgtctctactaaaaatataaaaaattagccgggtgtggtggtgggcacctgtagtcccagctactcggcaggctgaggcaggagaatggcgtgaacccgggaggtggagattgcagtgagctgagatcatgccaccgcactccagcctgggagacagagcaagactctgtctcaaaaaaaaaaaaaaaaaaaaaaaaaaaaaaaggaagaaagaatcaacggagtgaagagacaacctacagaatgggagaaaaatatttgaaaactatacatctgataagggcttaatattcaaaatatatagagaacacatctcaatagcaagaaagcaaatagcccaattaagaaatgggcaaaggacctgaatagacatttcgcaaaagaagaaatgcaaatagccaacagtaaatgtttaaaatgtttgacatcactatttatcagggaagtgcaaattaaaactacaatgaactatcacttcacatctgttagaagggttattatcgaaaagacaaaaggttaagtgttggtgaggatgtgggaaaaaggaacccttgcatactgttgatgggaaggtaaattagtactattttccattatggaaaaaggtaaaaagtttccacaaaaacccaaaaatagaactaccatacaatcaagcaacctcaccactgggtatatattcagaggaaatgaaatcaacgtgctgaagagatgtctgcactcccatgttctttgcagcactattcacaatagccaaggtatgaaatcaaccgcagtgtccatcaacagatgaatgaagaaaatgtgatatatatacacaatggcatattattcagccaagaaaagaataaatcctttcatttgcaacaatgtggatgaacctaaagtttatattaagttaaataagccatgcacagaatgacaaacatcacgtgatctcactcatataaaacagctgatctcatagaaagaggggctggggcggttggagggaagggtggttgggtagatgttggtcaaaggatacaaaatttcagttaaataagagaaataagtttaagatatctactgtattacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattccattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaattaaaatagcgattaccaggagctgaggggagaggaaaaattatttgtttaatgggtttagagtttcaactttgcaagatcaaaaagtactggagctctgttttgcaacaataggatatacttaacattactgaactgtacactaaaaataattaaaatggtaaattttatgttatgtgtttttcaccacaattttttaaaaatagcaaattggaaatgctgaaaaaaaaaaaaaagaagtaaaagatgaagtgcatggtccctatgataaaactatgaaaactataggtatgtgtaaaatgaaaaagtagaagaaaagcataaaatgatgacagtggccatgttacaaaggcagacattttggatttctttaatattcttgagttttttaatttttttgtaatatttatatcaaaatttctatttttatgcataattacttattgctgtagtcataaagtcagtggcaagtcaggactggaatacaggttttcctggctccgagccctgtactcacatgcaagattcagtcacatgagaccattggctccaggtgaggaggaccccctgccagagctttcccttcgaaacttgctgcccagggcctgaacaactaggtgaggctcctcctgagaactattgctgtggaattttagcaatgaccagacagattaagggatcttgaactcccttctcagataaaagcagagttactgtactgacagaaattgagggataaacaggtaaatgataactcattcactgcttcagggttcctgtgatccccagagagaaaagactctggagattcatacatgtgaggtctcgggagaggacaagacagaaaacacaacagcaaacacatccaagcccataccagaaagcctgccagggttttccaatttgctattttccattccctttcactccttaatctttaaatccaaaaagctgaaaggttccaataaacgtctgtcgtttccaatctctgcagccccacgcaaatcctgaagagcaattatttttgtggtgtctgacaaggtcattgttatctggccttgcagctcagagggatcaaactgagggcaggcatatcagggtaaacagaggatgcccaggagcatggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcctctcaaatgcccctgggcttttgttcccacagtcagaatgtgtgttctataaacagttcttgcttgtctgaccttttcaccatcctttcctttggtaattgttcaggttgttttgctccctacttttttaaaaaaattttttgagacagggtcttactttgtcacccatgctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacacatgcacagagtcactgcttccaccaccccttgtggttccagatgctgcagcacaggggtgaggctcctgcttccaggtcttctatttgaatagaggagccagtaagtagagaaacacattttttaaaagtaaacaaataggacttactcactttacctctttactttgttttaaaattattgaattttttaagagacagtgtctcatggtcacccatcctggggtgcatgatcatagctcactggagtcttgacctcatgggctcaaatgatcctctcacctcagcctcccaacatgctgggattataggcataagccattttgcctggtctgactttacatcttaaatatatgtgaaataacttatcttttccctctccactgccagaaccatggttcacactgctgttacctccatctggaccaagagccccacacgggtcttcctgcttcacttctctaccccagtccccccaggccccaccagcattctccagaaagcagccagcatggtcttttcaaatatccatcagattacattgctccctgccaaaagccattacatggcatccatctcactaaaattactttcagattccttatctcgctctggaaggctctccatggtttctgctcatttcatcaccactctccatgtcctcacgccctgcacacagtgtctctgctccagaaacatttcccagttcgtcctcagctctgagtcttcccttctgtttcttttcttgggaatgttcttcccccagatcattgcaaggttggctaatggaggtcttctctgaccacccgatctggagcccagtccttcgccgccattatccattcttctttatagggtttaccacaatctaaaatgatctcatttgcttgttcaggtgcctgcctcctgcccgttcctcagcagactatctgctctattggggcaggtgtctcactcactggctcactaccaagtgcaccctcttctagaacagtgatgactggtacatagtgagtactcactactgaaaattaataaatgcattaatcctttcaaaggaaaagtaagaagggtattggatactaagttaaacccatggttttactcaattattcaacgttttctcaggaagtagtgtatgtgcccttagcttaataattccatcatttggtctcttctctctagtggctttaatcctgattctctccaaggccagatgttacagtacagagcagctcttctctgtgatgaagggagaggaaatataacaatctggccagctaattctagggttatagacacagaagcatgaatatttagattccaggcatttcagctgacagaaacattttatatcagttctaatgaaaaggattgactaggtttcacttattgcttgccaactggaattttgttaggcacaattacataatgcagaagtatttgagctgtgcctacccacatcagaatcctaaactaggtttcaaagggactacattccattttaaagaaattcctagtactgctaactttcctggaaataaaagctatccctccctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaataacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagacggaaagcactttttttcccaggcagcctccaggaatacggaatacttttgggaggagaagagccatggacgggtgagtccttaccccaggatgcacaaacaccacagcaagacaccaatgactgccggaagttcggcggttcctccttctccggagcagcaggcccagacttcacccggtagccattatggaacaggtcccccagggacttcttgcggcgcctgccgggtctgtaaagctctgtgccggttctgctggatgggtggcggtacaccagaatcttactggggatcatggtagaaggagggagatgggctaggctttcggctcccttccattcacttcttgcaggagtcaatgctctggaaagacctggaggagcctgtgttcctctgacccgtgctgcaaacaggtcctcctgtccagcgcagtgtgggtcaccagcatctatgtcctggtggagccaatagacactctctcctccctcaccctccagtccctcttgcaagaaccccggcatgctctgggcactggatgcacgcagccacatcagaaaggcggttaagaggggcgggggaagcactctgatccacgatgtcctgcgagctgatcaatcagcttcacgctggaaataaccatgtaagctcctttggacatggtttagggggatagaaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctcccaccactaacataacccaaatacgcaaatcctctgctaatcctacatacaggactgaggaagaagagggattctgggctatccagaggaagatgggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagtgattaggtttagacaagatcatgaggatagggccctcatgatgagattagtgccattataagaagagagaccagagagtttgctctttctccctctctgccatgtcaggacacagtgagagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatccccacctattttttcagacctctagcaaggctaaaattattggtagaattttcaaagcataacatttcttctcaatgtggattagttcattcacctgaccatgacgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgagaaactaactctccaacacctaaagttgtctggaaatgatagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatatttatggtggaaataataccaatattacacaaactctttcagggactggaggaaaagagaacccaacttgatttataatgccagaataatcatgacattgaaacctaataagagtattatgaaaagaaaaaaaattacagaaaaatatatgtcatcaacatagacacaacaatccttaaataaatactagtcaaatgaatccagcagtatataaaaagaataatactttagaatcgagtaaatagagtttatcccatgagtaaaagattggtttaaaaaatgaaaattaattaatgtaattcaccacattgaaaaattaaaagacaaatcatatgatcattttaataggcatcaaaaaataatgaaactatgttgtgttaagataatgtgtcgtgccccccaaaaagacaagttgattaatgaaacagagtccagaaatagacccatatatatacaatcaattgatttacaacaaaagcaccaatacaactcaatgagaaaaataaagtcatcgccacaaatggaaggaaaaatggatatctacaaagggaaagaaatcagtctcaactcttacctaacacaatctacaaaattagtttgagatggatcactgacttcaatgtaaaagctaaatctgaagcctctataaacaaacacagcagagtgtcttgaggacactcggataagcaaaggcttcttagataggacacaaaaggcactcacatttttaaaaagactgataaattaaatatcagtaaaataaaaaacttctcataaaaagacaataaattaaaagataagccacagattaagaggaaacacttgcagtacatttatatgacaaagaacttacagaaataaaaattaaaactacaacaagatggcaccacaaatccattagaatggctaaaatttaaaagttgacattatcaagtgttggtgaagaaacaaagcagctggcaccctcacacgttgctagtagaagtgtaaaatggtgtatcttcctttggaaaactggcagtttcttgtaatgttaaacatgcatctatcctatgacccagagactcaatttctaagtatttacccaagaaaaaaaaatatatgtccacaaaatcatttgtacaaggatgttcataacagctttattcaaaataagccaaagttggaaacaacctaatggccatcaacagggtggtttgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatttttttatgttcaagggaggagagagcagatattgacagaaatgagcataaagaaacattccaggatagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatgcctaaacagagatcatctgctgtaaccctgtaaattccctcccaacttccagtgggcagtatggcatgaaacccctgcaactcagagatggctggtttaattggagaagtgaaggatttgtattcaggctctgccaccagcagctgcacatctgagtaagttatgtaactcctagcctcatttcctcatctccgaaatagggattatgacatctacttcacagacgaactatccagattaaagaaaacgatgtttgcaaagctctgcacagggtctgacactcagcaaattctcctccaaaaatctgccaaagcactagggcccagtcaaactggtctatattctgccatcgaatgccccatcatcactgggcaatctggtctcctactgtaaataaaaaccccacctatctccatggggcacatctgccagcctcttcctaggaccctgtaggtgtggcaataaatgtggtccctggaaccagcagcaggggatttggttcctggcatctccacatacgagccacatgctcttggaagttattccaaccctgcctcaagtctctgacttttaaaatgggaaacacttttcaagataaatctgttcatcacaagaaaggatttcttataaatttgaaatatttaaaagagaattctatgcaaacgtatgcacacatacaagtgaatgtgggcccatttctctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaatattgaccaagaaatgaactcagacgaaattgacctcttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacggttaaaattgtccttggcacataggaaatgttcagtcagtgcttgctataattattactaggagccagatactgggctaaccatattggggatacaaatgtgatttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattacccagtaagaaaaaactgtgccttgggttcaaatggatgtaagttttgaccctggctctgctcctgatgcactgagagaccctggctgcttatatgaaacctgaatgtctatgactgcatgtaaaaaataaagatgagaagctgggcgcggtggctcatgcctgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacagagcaagacttcatctcaaaaaaaaaaaaaaaaaaaaaaaaaaaaagaaagaaagaaggaaagaaaaaagatgagaattatgcctctcaggggctgtgacaataaattgatctacgtgtgttttaaaatgcctttcacacagaatatgctacataatcactcattcctggtctcctccagaagtccctgcacttggcctctctctctcgggtgtaatggattggtccccattgaaatacatttccttttcagagtcatttatccctcagttagaaagaagtattgaccatggggaagggggactgtgaagccacctgggcatggcagagggggccaggcacagaggagggagcacaaaagaacgaacaatgaagcacatagagaaataaaacctaactcgacttgcaagccagtgatggccctatttttagctgacaagtgagtaatctgatgtgtgtgacttgaaacagggaacataaacatcaaggctgaatctataaccagccacatataacttgtactataacttattcccagaattctagactgtttgaattaagtgtctgcaggtctcttcttcacgcacttactcttattaagtttgggaactagaagcctgtgtcatttgcacaggtctcaagttacaagggaaaaagatgctttgcttggtctctggtttgactattccaaagaatctttcctaatctccaattcgtctttgtctcccaccccaccagcctccctccctccttcccttccccctgaaagctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctcccttatcccacttcccatggtgagccccagctgggacgctgacacatggccccaacttttcctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgactattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttgccaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggtcaacctctgatgtagctgacatcttgaaatgaggaaggaatgtttaatttgagaacaggtacttctacatttcacaaggtagaaatctgtaaataacaacatttggaagttccttctgtttcctgcaacactcactttagaacctaatatcatgctatttttattgctctggcttaattcagttatatagaaatcatttctattcaaatagacgatgaaatccttgaggtcaaggtctctgtccaacttctttgggtataatccatcgtgcctagcacagctgggaactttgcacttgcttaaagtgttttcttccctttctgaaggacagtgattcacatctctgcttttgacatgcaaggacttgacgatctatttaacctaaggggagaagagtctctttcaaagaatggattgtcatccccttctccctgcccctgccatgtacattatgcttctaatcagtctggaataaagcgatgtcatgggcataaactaatttcttccaatccaaaacaagttagcaagtctcattttgtaattctaaagtcttcagctcatgtatttatttcaacatttttttcctataaataaatggctgtgtgacttgtctccttctttgtgttcatatcccaatgtccagtgtagagtggccttcactaaatatgtgtagaaggaatgaggaaatgaatgcaagatgggcttagctcataaaccctttgttttgttagagacttttgccaactcttttaggcagttacaatattttgatgggcaagacctgtgctgttgggctgcctggtcaaacccatgcatagtgaaataatccgtctccaatctcagcctgcatcctaaccccaatttgtccctgagtgcaaggtcactgatctgaatttgaatggcaggctttgttgacctaacaactctgttaggctcacccatttctgcatactactggtgagtgacagaggatggacactgaaatctccatcttttcatagaacccatgcaagaggcacaaaaccatctgcttagtggtcatgtggcagcagacagtatctcagaagtcctcgcagcatatgacttcactgatgaagatggatcacacttgagcagggattcttgatctctgcaaaacagctcatacacaacaggaacaatctcacagataagaaaaactccagaagttggtctcgggctatgaaaatttctgccacaatatgatttatatgaaaataaataaagtgggtctactactttatcattagcaataagtggattctttcttcctgccacagacaaactgaggatgtaaatgaacaccatactcgcattgttgcttatgctgttgttcttcacccactgcctgaggtgtaggtttgcaaataaaatcaaaccatcattattctggactgattatccaattagagaatgaaataggccagccctgtcttccttcttcttccatcaaatgccattcttgtagccatttcactgacaacatgaggggccaacagaagaaataaacaggcataaatttcaaacccaggaaatttatgtgagcaaagggaaagaatccagatatataaaatgaattaatcatcaataagtcaccacatccctattacatggtaagttcttttctgggagctgttagggccagaaagggactgtaagacacagtccctgctttaaagaagtacaaacaatcaccaaaaataaaagcaaaactgaaaaacagcaaataaataatcatttatcagaaccaactatggactatggatagtttaaaagtgctgagagcatagcccacatggcagaagtgcataaataatgcaaaaccttacattggctgacaatttaaacttcccttcatgatcattcttctgtcagaaccgctgagagagataaagaagataataataacaaaagaacttcaagtttctggtgattctaagtaggttctagtttcaggagtattccaacacactatgttaccttagacaagtcatgttctctctttgtgattaggtttctcatcaaaaggaaggaaagaaggaagggaggaagaagggactgggagtgttggtaatagataacccttaatatcccattcagatcaaatttctataattataatgtggctctctgcctctggaggtcactcagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttctttctttccctgtctctctctctctctttctttctttccttctttctttctctttcttcctttctgatggagtcttgctctgtcaccaggtgggagtgcagtggtgccagatcagctcactgcaacctccacctcctgggttcaagtgattcccgggcctcagcctccccaagtagctagggactcaggtgagagtcaccaggcccagctaatttttgtatttttagtagagatggagtttcaccatgttggtcaggatggtctcgatctcttgaccttgtgatctgcccccccttgcccttctgaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatttctttttataaatgctaattgcaactcactaattaagagagatgttacactgggcaggaaaatcattgagtcaggaaatcttgcaattttctctagcatatttcatgaatcaaaagtcttgatctgatgcagttttttcatggcctagagggcagaataggagctgaataccacagcttctcttcataagggtggtatggaaatggactcccagtttaaaagagagtcaaatgtccatcctgggagaattagcagagtattgtggttaagggcagaggctttgaagacaggcctggactaatttatttttgcctatggtttaggacagagggtccaagactgtctttttcatcttgtcatctcagcatttaggatagcaaggggtacatagcaggtgctaaataaatgtgttgtgaaatttaagtcctggttctaccatgcataagctgtttcctagggcaccttccataacctcttggagactcttctgtttttttgcttttgtgtgtgtgtgtgtgtgtgtgtgtgtgtgttgttgctgttgtcattattttgtaaaatgggatgtctcagttggggttcctctgcaggagaacctgagaaaaggatttgattacaaatagttaacttgggaagtgatctcaggaaacaccagtaagggaacaggaaagtggggaggagatgggaaagcatccataaagagtttgttatcaagcatttatcactgtgggcaactaaaggaaaatcccactggggtactctggcagccaggatctacacatggctttatgtgtaaacagaagagccttgcgaccaaggggtgagggggctggggcattgatccaacacctcctgttggtcactggttgaggaggcattaagtccctagcacttacgacctgtagacaggcccacaagcaagcttcagtgactggagaaagtcctctggcaaagaaatgcagatgctggcaattcaaaatctagccacctgcactacaggtaagggcaagcgggtctgggttgcggtgacaggcaccaacagggccagcctcccaggaataataaaacctatgtcttaggttgatgtgaggcttaaatgaagcggcggatggaaaggactgattgcgaccctgcacactgtacctccattcactgagggcttcctgctgtcatgagaacatggaaaatgtggcgctccccactaaggcccctggagccatgcatcaggtagaatacagtctcaagggcatcttgagaccttatagatccagagaaatgccacttcctagccttggaaactgacaatgcacattagcatatggaaggctctgaggattcttatggttaagaaactctttaattaaatgaggatttcccaaacttactggagcacagagttctctttccaaataatgtatgccaactttcagtgtaatccaacactccatgaagcacattttgggaaaagaaggcctgagactggtgaattttacccagaaaagcattccataatttccagctcacccccaaaattctgctgacaaatatgtttccttaactacacccaaatcttctgatttcatcttctttttttctttttctttttgttttttgagacaaggtctggccctattgcccaggctggagtccagtggcaccatcttggctcactgcaacctcagtctccagggctcaaaggatcctttcacctcagcgtcctgcatagctgggactacaggcatgcacctctacatccagctaattttttgtattttttctagagatgggtttcaccatgttgcccaggctggtctcaaactcacaagctcaagcaccttggcctcccaaagtgctggattacaggcatgagccaccatgcccagcctcacctccttttttaatgaacccaaacccaccctgatgatttttttattctgcatttctcagattcataatggttttcacgtgtgatttgaaatcatttatgggagctgcatgagcaacttacatcctggagtttacaggtgttgcaccctgcccaaagttgctgagtgctcaccaagtcctgcttctctcagaggcagcattacctaatggacaggagtctccgggcccagctctgttgcttattaactttcccaacgtcatttgtaaaatgagaaaatgtctgttgttcacaggtgatatagttaggctctgtgtccccatccaaaatctcatcttgaattgtaatccctataatctccacctgtcaagggtgggaccaggtggaggtaattggatcacgggggcggtttccctcatgcttttctcgtgatagtgagtaagtctcaagaaagctgatggttttataagcatctggcatttcccctgcttgaactcactctgtcctgccaccctgtgaagaaggtgccttcttctcctttgccttccaccgtgattgtaagtttcctgaggcctccccaggcatgcggaactgtgagtcaattcaacctctttcctttataaattacccggtctggaggattccttcatagtagtgtaagaatggactaataccacaggttactatagaaattaaatgaattacagcacaaaacatccagcactgtgcagccaccaactaatgctcaatgaatgtcgcttgcctttcaaatttcttcctctaaccacccctagccctgattccaattcttcattacttagataattgtcatataaagagaaaatagaatgatgaaatggaaagactgttgcctgaataattcaggccacttagtgagtatctatatccatatagacagctgtgtagctacctctctacaggtaggtaccttaatatgcaatgtccatctgtatctatatagagatacagatatatagaggcagagatatttcatgcaataaatatttattaagcacctgctggtgcctggcattgctctgtgttggatgaaaatactgaataagacagacatgatccctgctcacaagtaggttacggcctagtagtacagacaagtcacatcaagaaacaactaaacaatgaagcaaacaaacaactaattacaaattgcttcaagcaaatgcttgtataaattgctataaaacacacaaattccagtgagggacactttagactgtgtggccacagaggcctttctaatgaggtgatagatcagtggagaactgaagggagagagtgggccatcaggggacgcaggggcaagtgccatccaaaggagcgggttgctgcctgccattgctgaggcagggagaagaagcctggggggtgcaggagaaggcagaagctctaaggccatggcaggctttatgggccgtaaggaggtcttggtttccatctaagaagaaggaaaaagtttaaagaggtgggccacaaaagcagattgaaaaagggttgacattttaaaagatccctgcaaacaactaaagaaaggagatgactgtgagattctcagagaattctttcctgcctgctattgatctccaaaaagtgtgattctataacaagagcaaacattgacagtgagtcagatacctctgtaatcatttttaaatcactcattttattcccacaacaccttacatgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatctgaactaaaacaataagaagatgctatgcaaaaaatgaacctgggtgagtactgaacactttaaaatgcaagactttactaaggctaaatagaattgaaagctatagcctcagaagagaatgtcacaaaaccctgacacagtgaaacaattacataactaagaagtgaggggaaaggatgggggagaaaatgaaatgtcattttctcttctttcacagcagaaagttcatctgttttacaccaaattaaaaaacaaagttggccgggcatggtggctcacgcctgtaatcccagcactttgggaggccaaggtgggtggatcacgaggttaggagatcgagaccatcctggctaacagggtgaaactccgtctgtactaaaaatacaaaaaaattagccaggcacggtggcaggcacctgtagtcccagctacttgggagactgaggcaggagaatggcatgaacctgggaggcagagtttgcagtgagccaagatcacaccactgcactccagcctgggtgacagagcgagactccatcttaaaaaaaaaaaaaaaaaaaaaaaaaaaagttaaatgaaaacatgactctaccttcatcttttctcctaattgctttctcatattcatatcagcatgtcttaggaggtaaaagttacaaagtttagcgattgcttcatttttctccaatttttctacattcaagtgaaatcacctttgcaaaattatgacaacaagagaaatctgacagagctgactccctcttgcttccaacttccaagctacccttagtcattcctgggcataggccaagctaactttgggaggaatttatagtttaacctttaagcaaggacagtaatagcccttcccaaaactaaattgtccttgtaaaactaacgaaaggccataaggttagggttataagaggtgcctgaattctgctaacacataagcgcagttaaatgataaccagccattgttctggaggtcacagatttgtaacttcctcaattactcttgtaaataacatcactactgtagaactgaagactggccctgggagatgtttttcagacttctggcatttctggcgagtgactgaccccacctggacccaagactcatgactcagccagtcctgtggtccccacccagaggactcaacacgagtggactgttttccatacgcttgtggttttacccccaagcaatcaacattccctgttccctagccccctgcccaccaaaccatcctgaaaaactcctaacctcctagcctttggggagactgatttgaaggataaccctagtcctccagggtggccagactcacattaattaaactctttctttacagcaatactgccatctcactgaattacttttgtctgtgcagcagacagggaaaatccactgggtgactacacaaataagcttaaacttaacagttttattttttaaaaaaacatgtaggccaggcacagtggctcatgcctataaccccagcactatgggaggctgaggcaggcgggtcccgaggtcaggaattcaaaaccatcctggccaacatggtgaaaccctgtctctgctaaaaaatacaaaaaattagccgggcatggtggcaagtgcctgtaatcccagctactcgggaggctagtacaagttcattttatataaatttctgtttgtctaacttatttacttatctactgtacagaaaaatatctagaatgatctttatccaatgtgatcaaatgttttatgatatttgctttggtttgttggacacattcttcttggcattttctgtgttgcttccatttctcttaaatgaatatgttgagttttttaaataataaaataattattttgaaaatacataaggaagacgtccagacttgctttacttgatcatatgaaataaactcctcttcacgctggagcaaaataagagcactcttatcttgggggttttggaagtatttctgtggtttctgggatgcaatatctcagccagaaaaataagcccttcatcctgccttcagcgaggcgagccccacagcaagggccaaagtctaggaggcctgagcatgaggctgcagtgtctccaagccccactgcctttaatgggaacagcgtcctggcaccctctccaggatcacagcagtgagctctgtcctctggtcacctgcgccaccaacaccctgacaaggtcctcctcctccttagcgatgggctgcctcctttcccacagcttctggtgcccccatgggttgggggcagggagggaagtagcaaagaattaagaatcagatccagagaagcatgtggtcatatcaaagaaggagtgtaaatagctcctatacaatgaggtgatcagatctctaagaggctcagggaaaataatcaggaataagtggaaagacagaaatgaaactgaacaaaagaaaacacttttagggagaaggaagtttgaggcaggtcatcatcctcaagaatcttctttgaggcaaaagagctgtatgccatgaggagaaaatgatacaggcagagcaagagaaaaataatgacctagtcattggctcaagattaaaagctataatagaccctttgatcctcacagtaactcctttaggtagtgaaggcaagagctcatctccttattataggtgagggtgataggattcagagactatagcttgttgctcaaggtcaagcagactggtgcaggtgcagcctggaccacaaggaggtctctggacctgatcactcggccatgggagtctcctctctctccccttcccccttttcatggaagtgagagttgtgtgaatctgatattccccatagtccccccctccatgattcctagtttgctcccagctcctctcccctctctagctccataactggggtcaaagccaggctaacttgagaagctgagtggaaatctcatttttggcttgctaagaagttgtcttgagacccctttgtttcatagggaggaaggtttcccagcagaggttaagttttgtgctcaggtttaaggcatgagtcaaggtcaagcttcggtagttgcccaggttttatttcaagggaagaaggagttcaaggtgatagctctctttgagggagggaggaagggaggactgtgtagttgtggatatggtagcctggccagccaatgcgtaagtgtaataagtaatcctcatactctcaccccatgctgcaagaactgtggtaataaccttgagcaacggcacacccttcctcctaacaacacaggtttaggctaaagacattatccattaaaaataaccacattttataaactttgtgttgtgtgagttttttccccattcttttttgaagcaactggcttggtacataaattacactgtgtgctagagaatatatgacacggctgtgaattacaaggtcataattttaccagcaattttagatgctgccataaaccatccaatgtctgagagagctctaatacattttgatttttttcctaagcccccagaatggcattctaggccagctcttaaaagatgcttcatttcttgcttttgttttaggaaaacaatagccaagtaacatcatccgctcctttctttcttttcttccctatagtatcgttgccttttatttttttgttaaattactagcatctatcttagatagatgttccctcagccttcttatgggaaagatgggcttatgtagggctttgagtgagcaaagttcccagagccacaccattttggcccagggcttgcctaaagacataacgaagtgaccttggaccaggtggttctgttcagtctcaggtggaaatgttttccctggtcttctgtccttaccttcttctccacttcaacttaagttacacctacatccttgcttttcccctaattttcaggcctttgttcatttgcaaacacttgccctcagtttgacctgcctattcccccctcctgtagctaacaaatttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtctgttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattcctccccctgctcacctttttctcttgtctggaatgctcttggccctccactccacttagttaaggcttttccatgttttaagactcaactcaagtccagctcccccagcaagtccctatggctacaggcacatctgcctacttttaacttatagcatatactacatgtggttcctaatcagaacataactcatcccatctgaatacaggcctaactaattggcgtgcactgagggagcaggggcagaccatagttctcactgctgagggggaatgtgactggttaaaagacctctaagtctagcccaggctatgctatttactacttgtgtgacactgcagacctcttggaacatccttgcccatatctgccaattcagagataacaataacatccatctcacagagtttatcaaatacagtaatgcttacaaaaggttttcacatagttgaacagctgtggaaatgtcatgtcttataaatgcacctaagtaaactcaggcaaccctaataggccctggttttgttagtcattgaggccactccttccatatgttatgttcccttggcactgagcttcctttcaaattaagaattgaattgattcatgcaggtgactcaacaactcataatttagatctgctttcactctcaccatgaaatacacacagacagctgacaccatgctcttgacttacgagcctatttttctaaaaggcccagtccctccaaggctctttcatccactcaatatggtcagccacaggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagcgatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattcagttatgagtgtgtttagagatgtgcatgtatcttgtagtcaacgcatggataacatgtgaattctatccaaagcaataagtgctctgcatacatttaaatgcatgtcttctcatgtttactcttctgtagtattatttaactatttattcatcttttgttatattgacttatgaaagactttgaactcttgttgtagaaaaggtatttggaattcccatatctataactagattaagctactctaggctgaaattgtgtcttacatttcacagtataccatgcacaacaagcagagtgctatgatccatatgtatctattgagtgaatcatttattaatctcaaattacatccccaaatcctgttctttccttcctttgcctttttttcctagatatcaagaagcacactgattctagttaagtagttattactttgagctcagttaaagatactaaatattggcactcttggtggcccccattccaagcatccttttatgtaaaagaactgtaatcctatgagcaaagacctgtaaaactgactgcagctaagggaattatgcccccatgcagataatgctgtggaccaaacagttccgataagcaaacaaaatctctcagacaattatgttcttgtttaaggccgtttgccttggaattcccaaaaggattctggaggattgcaaatttgctggggatgaagaaagaaagtactagctagagtttaatagattattggattaagacaggccagaaacagtcaaacaagaaaagtattatgcaaaaccttctaaggttctaatctcaccttatttctattttgattaatattttcctgggaaagaaaagatgggggtttttgttgttctctgactacaatccagagataacatctttgcctccagttttcatcaagataaagacctggaagacccgagccaaaaggaaggagctggaattttttttaaatctttctttctggtctttaaggaagttatctgaaaacccactggtactctccaatgggtaaagaatgagacagaactagcagaaagtgttaaagcattagacaggcaaattaacttagagacagtgggagaatgattccatctccattgattttccagtctgtaaatatgaaatgctggaaggatacttgtgacatttggaaagttttatctagaaatctccaattaattttagagtgcatagcatacatcaattaaacagactgcggggttcatatttcctacacggtcgtgactcatcctcggaagatctgacccatcaaggataatgatttcatcttgatattggtgactaatatttctgtttgtatgtccagtgtctgctacagagcctgacatagagtaagtaaatgctcaaacatatggataaatgaatcaattaaaaacctcataaaatctttaccctattaatcttcctcctatagcaggggttggtaaactacagcctgtgagacaaatctggccaccaccagttcttgcacaggacaccagctaaaaatgttttccccctacattttaaaacagctaaaaaaattagaatattttatggaatatgaaaattgtatgaaattcaaatttcagtgtcccgaatacaattttattgggacacagctatgtccactcttttacctattgcctatggctgctttcatgccacagaggcagagttgaatggtggtggtggagatcatacagcccctgaagccaaaaacattgactatcaggccctttatggaagaattttgctgacccttattctatagaatggaacttgggaacccttatcatttgtcattcattccattgttcactcagtggctatttactgagtatctcccatgcgtgcagtgctctgtcccattctggggataaaacagagagctgagaaagatccctgccttgatggaactcacagtctgggtctggagcagcagaaagaggctcatcaagtaaccttccaagcacctttgcaatcacaacagtgaggagagctaagaaatggtacatggggtaagcttccatgatgtactgatggttatgctaattactaaagactgtcaaatcaggacccaaattgtctagtgccaaggtggatgtctttgctccttcctttttctgccctgagacactcttcattctcagttgggtttcccttttagaatgacctgtgacatgtgtcttctcctcatgtgacactcttcctctttctaaccccagcacctagaacaaagcctgacacacgggagacactcagggcatcactgttgaacaaatgaaagaattaattcattaggagaagaaatgtaagcaaattcctgggcatccccaggccccagttttctcatcagtagaataagaaggatatgatgtactcaagcctcccagctcggcattctgcaatttgtcatgtcctgagagctggactcatctggctttctgattcactcctctctgtggacataaggcagactccctctgactcagcagcctgatgcatcttcctgagtgacacatgaactctgcccaaggcaaggcggccagccccaatccattccacggatcactgctgacagtgaatgggagtatacctgggggttttagccaaggtctgctcaaggtctttggcataaagggaggccaggttgaacacacaccagcaggaagagagatgaccttgacttcataaattggccataaattagagctaagaatcaggaagattctccttccatgcacatttctaaatggcagtttcaaggcaggtggctattttaaaacacagacacaaactcataattcaccctctttgtcccccaccctcctacatgccattgatctttcttttttttttttggaatcctgaaacatgatctttaagaaaagacaactggactccaggattacttcctagctcttcctcctctagaagccaccatttctcttcgctatctagaccccagggaagtggctttggcaaaagcacatttgcacccatggatcatttggttttcttgtcctgttaactgcctggttctgcagcacccagagccagataatagaggtgttccttcaccagccacagctactatcaggatccctcttagtccggaggtaacagaagcaactggttgaacgtgtttcctcctgggaaatcctaaatgttccatatggcaatagggaatctagagttgtgtttctccttgtattagggatattttccctctttcagtttcttcccattttttcccatctaaaatatgttttttccactttgctgagatgaagaccagccagagagtcaaaggaaatgacagacatgccataatagaaagaaaaaaatacagacttctgaagaatgagttgattcatgccatgaaaactcacgataaaaatattcactacttttttttggccacttgtcatagtgtgctgcctctgctaggcagctgaaagtgtctcatatgaaaagctctattatcctccacagaaatgacctttgggacccacccaacggtagtcaatggtaatattatactaacttgccccccaagaggaaagaatgaaataataatacttaaaatatgaatgcagagaagtcctcacttaaacacagtacttctggttcataaatcagttctgacacattgaagtacacatatgatgactagacgcaagtttattaacacattttctttctttttaggtctgagaaacatatctattcagaatccatacatttgttcattttttgaagctgacagcttgataggcaaaaagtaaagtgacagatcatttcaatatttcttttaaattcaaaaccaattcagtcaaaagaccgaaggaaaatattctacggagataaaatgataatgcaaacaattgaagacagtcctttattttagtgaaaacaggtaatgtctgtactctggagtcgggctgacttcctcctcttaacctgccctgcaagtccaattagaatggttttctgcggggagttgttttccatttatacttagcccgaacacgtatacctacttttcaaactcttagctattcacttgacatttgtcttcttcagtcttcactaaatagtctttggaccctttgggagtcttataagagttattttctgaaagttaaaaacgtaggaccttatttcggcagaggttaactaaaccaggcttcaaagaggattctgagggcgacagccactataatgtccattcctactttccttcactaggtggcagcacgtcacaacacatttttcagaacagtctggggaaaatgcagttgagctaaagtgaggttggggagtctctgcgggctatgggaggaggatacacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttctgacccagtttgtaaattcgagttatagtattttacgtttgctaaaatattcacctaccacagtaagaatttttgtttatctgatgcaacctgtttggtgttataggcagatgctaagttacaggctttgtggtggatactgggcaacagatgtggtaagaaggggagcagcccaagatgaaatttcctccaaaacaccagaggttcctgtctcaagcagagaaatcataatactgcaacacatactagtttgcaaagggcaagtcgctatggccaaaaatgattgattcagaggaagaggaagggaaggaagaagaaagagaggaagaggaggggaaggacatggaggagggaaaagaaaaggagaaggagggagagggagaggagaaggaggaagaggatgaagaggaagaagaaaagaaggaggggaggaggagttttaactgaatactgtatttttgccttaatgtaggaaagatgaaggggagaaggaggtaactgctagtggacattgagaagctgtcaatacagcaagaccttgccaaaggttgatcaatagcctctttttaaaattaatacatagtagatggatgtattttcagtgtctatgtgataatttgatacatccatattgtcaaactagggtaactgggacatccatcaccttaaaatatttatcttttctacatgctaggaacattgaaattattcttttgtagctattttgaaatgtacaattgattcatgttaacttgtcaccctaatgttaactggtcaccctactgatctatcaaacaccaagtcttatttcttctatctaagtgtatatttattcccattaatcaacctctcttcatcctcccctccttcctacccttccctgcctcagataactaccaatctactctctatcttcatgagatccccttttttttagctcccacatgtgaatgagaacacgcaatatttgtctttctgtgcttggattatttcacttaacacaacgacctccagttccatccacggtgccacaaatgacagggtttcattctttttcatggaacagccttcctttgaagagagacattcactctcctgctagagacagcctccacctggcctgcttcacccatttgttatcttcttgtccctgtaagcatttgtgtttgcaatctggggtttatagattcatctttcctatagtagggctaaaatatcttagtttaaactccaagcctaggacaacagctggcacattacacttgttttaaggtttgttgagtgaatgatgataataataaagatgatgataataatgaaaccggcaatatttatgaagtttcttaaccagggcagagactagggtaagacagtgatgcatccagggaacaaaattgaaaggcacgctcattttctttttctttctttcttttttttttttaattttgagacaggggctgactctgtccccaggctggagtgcaatggcatgatcttgtctcactgcagcctcgacttcctcgagcaatccttccacctcagcccccaaatagcaggaacttcaaacatgcagcatcatgtctggctaatttttgtattttttgtagagatggggtctcaccatgttgcccaggctggtctcaaactccaggactcaagcgatcctcccacctcagcttcccaaattgctgggattacaggcatgagctgctgcacccagctgaggccctcgctttcagggtcacttgcttcatcttgctcctagcctatttataacataggccagttttctttacatgatttatctcattggtagggcttttaaacatttctgtctctcatcacatgtatgagttactactaaaccgtgggtatatagtagtaattaaaagctcaggcgctgagatcacaaagatgtgagttcgaattcttgctgtatcacttgctgaagtcatacagcaagtaagacaggtcacacaggtcacctctccaagttccaagttcctctacctgtgtgttaggattaaatgagataggccggtaaagagctttgtccaatacctgccacaaaatatagtcatgcattgcttaatgacagggatgtgtcattaggcaattttgtcattgagcaaacatcataaagtacacttagacaaacctagattgtatagcctcctacacacctaggctatatggtatagcctattgctcctaagctacaaatttgtacagcattactgtactgaatactgcaagcaactgtaacacaatggtaagttttgtgcatctaaacatataaaagatacagtaaaaatacatattataagcttatgggaccaccattgcatatgggaattgttgctgacagaaacattatgtagcaggactgtacatagcagctataataataataacaataacaagagcaaaaataacttattttattcctattacatttataaggatttcagagaaaaattcatgttcaggtcatcaaaattgattagtagctattgtatgcaaaacatagtgccagacatttagaggaatataaaagaatatataacatagctgcaaatctagaccagggatcagcaaactttctctaaaaagaaagataataattttttaaggcttttttgggtcctatcttcttcatgtcattgccataaacaatatgtgaacgaatgaacatggctatgttccaagaaaactttatttacaaaaacaggcagtaggccagagtggctaactcctgatctagttgatgagtcaggacaggtacatgttacttataaaaacacaaccacatcagaagatcacccatgatcaaaagagtggctcagactatagtggttttggaagaggcaagtaacaggataataactggttgagtgcaggtaagcagagaagacaagaaagcagctgctagacaagaaactaccaaaaccatggcgatggaacatatctgagattgggtaggagtggttggtaagtaggctggctagagtgaaaatgggagaaattcacaaaaatgcaaacagggctggagaagaaggctaggtgagaatataaagaaggaagaccatgagactgagttttttgtttgtttaatttaatttaattttttatttttattttttttttaagatgggatttcactgtattgcccaggctggagtacagtagcacaaccacagctcactgtagcttcaacctccaaggctcaagcaatcctcccacctcagcctcctgagtagctgggaccacaggtatgtgccaccatgccgggctaattttttaaaaaaatttttgtagagacagggtctcactgtgttgcctaggctggcctcaaacgatcctcttgccttgggctctcaaagtgctgggattacaggagtgagccaccacactcagccaagtttttacaaaaaggaagtatctgctgtgctcccaatctggccagtgaggtttgcaatccactcaggaaataataagctaattttaccctttatgagctgggttgctaaattcctacctggccttaaaggggtaagtcgaatttagtgattgtgatatgggagcaaagtgtcaccacactagtgtttggcatttatttcgagtgatatagtgtgtcttatgaaaaatgggccaggcacagtggctcacacctgtatcccagtactttgggagaccgaggtgggcagatcacttgaggtcaggtgttcaagaccagcctgtccaacatggtgaaaccccatctctactaaaaatacaaaaattagctgggcgtggtggtgggcacctgtaatcccagctacttgggaggctgaggcaggagaatcacttgaacccaggaggcggaggttgcagtgagccaagattgtgccactgcactccagcctgggcaacaatgcaagacccaatctaaaaaataataataaaaataaatttaaaaaaaagaaaaatggagctctgctcaccacctatcatctgttcttactctcatgagcaggcttgggcccaggcctgggcatctcagtgtctgcaagtgagatgactgggaaagaagatttgttcaaataagtcaccctgctattggagagaggctggaccctaagagagcccttccctcgaggagcgggctgagatactgtatccctgggagaaggttggaggtgaggctccatccctgggagaaggtcggaggtgaggctccatccctgggagaaggtcagaggtgaggctccatccctgggagaaggtcagaggtgaggctccatccctgggagaaggtcagaggtgaggctccatccctgggagaacatcggaggtgagactctagggatgagttagaaatttggcctgggacctccctccgcccctctccttccctaatctccaacacaccctgtatctattttcctgaatgagttgaccctatcctaatttcagagagtttaggaagcgatatcaaccaaattggctctagacaaaatactagtgactaataaagtcaagcaaaggtgctcattcttactagtaaccaaggacttggaataccttagaaggggattacaagtggaagatccaagagctatgggaaaagggttctgctgttcaagttgaaattgtaatatggaatatcataggatgagtatatctcaagatgtaaatgactcagattttaatctcaaaaacatatgaaataaaggattacattaataagaatactgatatttaggagcacaaaatagcaaggtttactctaataccagaatcctggaaacttgcatagcagctacaactagaattcaagttcagcctcaccgtgggctggaccagcagatctcaaagtgtggcccccagatcagcagcagcagcatcacttgggaatgtgttagccatgcagatcctcaggccccatcccaggtgtactgaatctgaaactctggggatggaacaccccaaatctgtaatttaaccagacctctaggtgactctggtgcactcaaagtttgagaaccactggtctatctagaatacatagtgtgcttgttccaaagcaattgtccttaccacgacccaaagagcctcacagaatagatttcggaaagtacgtgtgcgtgtgtgtgtgtgcgtgtgtgtgtgtgtgtgtgtgtgtgtgtgtgtgtgtgtgtgttgaagtttctcaggtattcaggtatgttcctctggtttaagaaccaccactgtgccaggcctctcaacagtggctgcacaagtgaaattattcagagaacttgaaaacattctggtgactgagttcatccccaattctcatatgcttggttagaaatacagtctggccaggaggacgtgtcagagttcctgggtgattctaacatactgccaagatcatttagcccatagaagaatcaccaggagaatttgttaaaacagattcctcagccctacctttcagagattctccaggtttagggttgaactccaacatttttatttctattaagctcccaggccatgtgctggcttgcagaccgcacctcgagtagtcctgctctaggagaaacatgtttatattttagatacctgaaatcttctttgggctgggatggccaactttcctccatctgttcctcctctaaattcctataaacttactgttctttctagaggacactccaattaagttattaacatcttatagaggcaagatctatgttttccccatctttgggtcactcctagcacctagggatttgcacacagtaggtgttcagctgaataatgcagtcgaatccctgagctggtttcaggtgttcattttctccctatctgatctgctagccaggtcaatccattatggccctggtctcatggaaaagaatcaaggcatctattttttgaagatgatgtgaaggtaaatatacgtccagtcctagagatttaggttgctgaggaggctgttccaataataccccagatgaagtacagccatctggagaggttttggcatccatgcaaacctactgctgaattcgttccttgaagacattcattttaggatggtatttccaatttggcatataacagagccatgcaaatcaatgaggatttagaatctctacttacggagggcatcttatttaaagcgtgtccctgacaaagcaatatcaagggaacacaattggaaatctcttggagaggagtaatttctctagaagcagttttagctatagcagcgaccggaacagcaatgagctccctgaaatacatccaaatttttagtattccacttggctgggctgccttcttcagagcccaatcatagggacagaacttaataatgagttcatttttcttgtcacactagagcaattcagttgcaatgctattcataaggtgtatgttgccattgaattctttctcaaaaaaaaacaaaaaaaaaaaagctcaagccaagagtagagccccatgtcagtctatatgcgctaacaaaataccttagactgggtaatttataaacaacagcaattgattgctcacagttctaaaggccggaatgtcccagatcaaggcgacaacagattcagcatctggggagggttttttctctgctccatagatggcactttcttgtttccctgcatggtgggagggacaaacagcctcccaagggcttctttcataagggcaccaataccattcctgagggctccaccctcatgatctaatcatctcccagaggccccatctccaacacgacggcattgggatttcatttcaacacatacatttggggcagatacaaacattcagaccatagcagcccataacatctagcatgatactatttcaacatggactaatggtaaaaacatggattgtttttatttatttggctacttgtatagaatgggtcaagaagctcagaagaggggactggtgaacatgggggaaaaaagtagtttggaggctggtaagttattaaaaatgtgttaacttgtagcttgagagacagcatagtatcatatcaagtaacatggactttggaggtagattgcctgagatcaaagctgagctctaccatttactcactaggtgactctcagcaatttatttaaccttctgaagcctcagtttccccatctgtaatatgggcccccaaatgacacctatttcatagtactgtttggaagagcacttgagacaattatatactgtatgtacatacacatacatacatatatatacacatatatgtaatatgtgtaatatgaacacatctaactttattctagttatggaagcacttttcttttggatttctctttctctcaaaccccccaacccccactctcctaaggacacctggcccaaaaagggaaatcatactttttcttttctttatttcactattcttattctaaagaaacccacagactacagacagcagtttacttagaaggctctgggcttcagggaatctagatgtccaagttgaaagtcagctgcctggaacatggagtgggtgacctctgggggcactcaggggcccttccttccaggcttcgggcactgtcactgagaagcaactcccttgggggaggggtgcttttggtcatagcggttgagtcaagttatcagatgtcaaatagcttataggagttcaaagtgagcctatctccaccactgctaaccacgaactgcccatctgagcatgatgaaattggcccccttcccctctccccttgctacttaattgctcacaaatccagcaaattgcaggaccagcctctagggggcaccagagacctttcctttcagagcccaaaatgccatttcagtagcagcagagtagtgtgtcctggagctggagcatggtccagtgtctcttgtgctttttggcctactgagtccttaagtatatttaatttaatttgggtagggtggtagagggttccttttaacagtgtattcatgatttctctagcatttcttcaggaaagttatttatttcttttagatatagaatttttaccattggtccattcactcaaaatcacttcaaaaaacatttgctaagcttccactatgtgcaagagtgtcctgggcatacaaaaagtaaaaagccatggtgtgtgctgtcacagactcattctagagcagcgtggtcccacagaactgtctatgatgatggaatgttccacatctgtgctgtccagctccgcagccaatgagccacatggggctcttgagtacctgaaaaacagctggtaggatggaggaactgagcttttaaataggcaaatgtggctaggagctaccatactggacagcacagtgtattagtttggtgcaaaagtaattgtggttttggccatttttaagtggattggtaagcctggctatttaaagtgtggtccacagagcaggagaatcactacacctgagagctggtggaaatgtagatctctgacgttagcataggcttcctaaatcagaaactgcattctaacaagatctcctggtgcttctcatgcacagtaaagtttagaaagttaggagatgcatacaagtggttctcatcctgactgcacttcagacacaactgagaaacattaaaagaagctgagcctaggtcacaccctccacccagagattcttaggttaatggtttaaaggcttggcctgaacatgaagagttttaaaagcactctgggggattctaataaaaattcgagaaccatcccagcataagtcagtacggtggctccaaaactggagatcaccaggagtgcttgttaaaacacagactgctggctccaactcgcggtttctgatccctgggtctcggttgagctctaagaaccctcatgtgtaacaagtccccagtaacgctgatgctgctgatccaggaaccacactttgagaaccactggtctaatcattttaaaagatgggctccagaattggactaacctgagtcttggacctgccacttacttagaccctgaacctcagtttcccaaactgtaaacttgggctatgaatatttactcatcgagttattgtgaatattaactcagagaatgactgtgagatgctgggcatagtgcctacttttaataagcaatcaataactgttccttactatcatgatcctaagaagactcactcattcattcattcaacaagtatgaactatgtgtcaggcactgttccaggtactagggacatagcgaaaaacaagggggccacagtccctgccacattgctatcatggaagctgcagtcctacctgtcagtacaaagcaggctgcgtatggtgctcctatagcacgaatcctaacagcacaatacaaaggtcagagaggaattcattccaatggatgagaatgggaaagctgcacacaggagctggagtcagagctgtgccttaatggggagaaggattacaacctgcagagtcagggcaggaacttactcatgaccaggcacagggcagagacagcaagaagatgcagctagcagcctagtggagctggggcaggaagtacagggaaaggggaggcaggaggcagggctgtgcatatggggatgccaaccagggtctgcctccactctctggccaaaccatactatttgtgtttgtttaaatcccaaacactgaaaattactgatgtcaggaaactgaaaccaggccacagctttcattcttgattattcttaccaaatgcagaggccagtcaacagaaggtccagagattcacagaatcatcctgaccctgcctgaaggtggggcggggctcttcagccaagcaggtggccttgggcccagatgctccattgaagcagaggaacagagagatgcttgagacttcagctgagccctgggtggggtaaccattaaaaggaagagtggtgtgctgaccccatccaccgcttcccttaggaaaatggtggcctaccaccacaactctttggtctcatttgggtttctctgtaaactccagaaagcaataaagcatgattcctaaaaaagagggctactaggtggaggttatgcagacctaatatgttcccctcagtcactgcagctgcacaggaaggggcacccaaacctcagagtaagttgcgtaagaacaacagacaacaggcaagtctgtctagtaactcacctgttcccatgaaaagaaaaaaaaatgtcactccatgcaaatgaggggtgtgggagggtgttgagcttcaataaggctctccccaacggtctcctccctaacaggctgtaaaataacatgaagcatggccccaaagggccgtgaatgacccctggagcaaaggactccaaaaggctctgcagagcttttggcacatctgaacaggggcccggatcccagcgcaccctcttctgggctctgactttggcaagttactcaacccctcagagcctcagattcctctttggaaataataatgggaataataatatgccccttttggtaggcagaacgatgaccctcaaagatgtctgtgttaatcttgggacctgtgaatatggtcatctacatgccagaaggaaatgaacgcagcaggcaaattaaggttgctgataggctgacctggagatgggaagagtatcctggagtatccaggtgggcccaatgtaatcacaagagtccttaaaagtagaagaaggaggcaaagaagagatggcaggaagcaagatcagagtgatgcaaggtggggatgcacccttagttgctggctgtgaaggtggagaaaggggccatgagccaaggggtgtaggtggcctctagaagctggaaaaggcaaggacatggaatcttccctagagcctctggagagacccatgttggacttctcacccacagaactgcttggaaatagaaaacttctacaccattttgcaaggttgtgaggctgatgcttggcactcagcaaggcctctctctttcttccttccttcctttcttccttccttctttcctttcttccttccttctttccttccttctttcttttctttccttccttttattttccttccttcctttcttccttcctttccttccttgcttcctttcttccttccttcactttcttccttctttccttccttccttctttcctctttccttccttccttctttccttttcttttccttcctctttctctgtttctctttctctctttctgactttctttcttttcttttcttttcttttttcttttctttagcagggtcttactatgttgcccaggttggtctcaaacacctgagctcaggggtcctcctgcctcatcctccccagtagcaaggccactttcttctctaggctgttattagcttctgtgggtacacaccatgctccacacatactaggcttcattctccctgtcttagcccatcattgcagcctccactgagccccagcctctcacagaagcctatcctcattctcccacccacatgagctctcactcctctgaactcccatggcctttacagcctgtaccttgcaattacgggcttaattatatagtgggtagtgttacctgctgtcactgcatgtgtgtttattttggttccaaaatgagattgaaactttagtctcaaacaggaacaatgttttgtccttttgttgttgttgtttttaagcacctgtgctttttttatataatcctgtttttattgccttctgacacaaaaaaaggactattttgggcatatatttataagcagataccctacatcattgcaactgccctgtgattgggcattaactcatttttctattttctagcagagtttactgaaggttttaaggtttaaggtctaaggccagttctgatacagacaatagaatcaagtttatagttttccaatcatggttccaatgaccatggtcccttatcatatgccgatttcatcagtcaaagaacaggggatggtgttggaaatcacagtaccagtaggatacagggtggcccggcatgtgttcctctcatcccagtgctgagcacacagtaggtaataaaaatgggctagaaaactggctggtgagtgcatcattactttcctcctactcccttctttaaatcctacaagatcaccctcaacaaaaacatacacacaggcaaggtgcagtggctcacacttgtaatcccagcactttgggaggctgaggcgggtagatcacctgaggtcaggagtttgagaccagcctggccaacatggcgatcccgtctctactaaaaatacaaacattagctgggtgtggtggcaagtgcctgtaatctgagctatcggggaggctgaggcaggagaatcgcttgaacccaggaggcagaggttgcagcgagccaatatcgcaccactgcactccagcctgggcaacaagggcgaaactccaaaacacaaaaacaaaaacaaaaaaacatacacacaaacagaggcagcacagcccattgacctaccttggggatacattcccaaaagagaatgagacagacggacatatgagttctccttggagcatgttattcaaatctcaaaataagataaagctctcatttcaaggtgcatttattttagtgaggtttggatttgtaagggaaacaaaatgaataagttggtgggtggggacaggaattaaaataagcagcgtcttgctgcttgccgacatgactgtcctcacatccgctgccttattttttattctgttctggtttgttttctcctgcggtgctttaaaatatgatgggtaggttagaaagagagaccgaggtaatcctggcttctgttcattaagctcgtatgaagtacgtgctgtgctactcacattacctcggtgaatccctatgaggtgggtgctgtaattagcccattgtacaggtgagataactgagcctgaggcagataaaatgctcatgctgagcgacccatcagcaaacagtttagccaagatgtggactgagttggtggagctcagagctgagctttaatctactctgcgccaatatccggggtgttcttaagccccagtctctctgtcccagatggagcaggtcggatctccaagctgctgaggggcactaggactcgggagacaccaggctagctctgcattcttctggtcctcctggcatttctagaaactggaggtgggcaaggaggagggggaaagaggagccaggagaacacggagtcttaaataagatctcttccctctcttcctgcctggagtgaagccctttatgagtaagcaccgatggagggatgccaacacaacacagcaaaactagccctgtcattcccaacccaggcctcacaactccaaatcattcaaggggtaaggacacagaaagaagagcagaggaagagtgtggacataaagtcagaccacatactggggaatgcacccctcccaccactcccaggagatgtgaccttggacaagataatctctcttagcctcagtttcttcatctgtaaatggggaaatgacaagtcctgcctcataggtttgctctgaggattaagtgagtccgtgtctgtgaggggctttccagagtgcccatcacacagtaggagctgactacatagtagtgtctctatgagtacaccgttacatgcactaggatgatctgcacaatgaatatattctgtactatacaacacgcaatcatatgccgacaattgaaaactaaacacggtgtggggagcgttctgggacaggtaagggcagggaccctgcattcactctggtttttatctcccacagagccagctaccgcacagtcctgtaccctcagcagggccaggaaagtttgtgcaggagaatggggatagacttcggtttcctgcatcttatcccaaacctcagccagaaaaggcagcacccttccactttccaggagaagggcagccatgcctgaaatgcccctatttaatgggattatttcttctcctttataagtcatatctcatgggaatgttcattttctctctggaagctcattggtacaatggttgtttcacaatgtaataacccatgtattaagtcagatgagaacctccttgaaatattattgtactgaattctcttccataacagggagatcagttttagatttcacccaaggagatttcgctaccaaagaacctaaagcatttcattaaaggtgctttctcctacaagaggaaagaggtttttttatttttgttattattatttcatatcccaaaaggttattgttctatgtgttcaatttcaatagtacttatgcttcctaaccataccgtatcatttacttccttattaggttcagtgtttcctgctttcccaacactgcagtataggagggtagggggataggactctatttcttcactgttgtttcccaatcatctggaatggtacctgacatatagtagatgctcaataaatattaatatacaaatggaagcacatttagagcacatttcttttggaaagcgaccacagttgatacaaagatgtatctcattagaaattcatttccacctcttttatttcctattcaatttttttcacccccattctgtgtttgtgccaatagattttttatgagatcacaacatatctccaaaaatcagaattaaatcatccacaggaaggctatggatttcaaagcataccagaactcctggccctaaaatgcttcagggaacgtgtcactcaccacaaggaagctgggctccacacttttaccgggggcatgttctgctcactgcagaggaggatgtctccaccacagtcaccagggagcccttccatcacccaggcccacaggggaccaagagacaatggacactggcagaaagtgcagattcatgaagtgtgaggactagaaggtaatttcatttaaacccccattcttcagatgagaaaactgaggatccagaaaagcaaagtggttgttcgagtgcacagggtaattaagcacagctcagtgaagaaggcagatcccacctctccccttccccatcgatttccctgtgtgtgcatgggtatgtgtttgaactcttagcaacaagatgttttaaaaggagtccctgttaacaactcatccataattttgactcaggggtgctgctgatagaattctactagcttccctgtccaccccaatgacctagatcccaaatttcccattaatgacccaagaaccttaaagactttctgagctaaaagattcttcgaagtcatctagccaaatctttatcttacagatgaaaaacaacaggctaggtaaagaaaattgagctcccaggtcacaaagccagttagcagtgaagctacagcagctgggactgctggcacccagggccacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcaggtccaaaacaaaaacttttccttagagcaagagaatataattctaatgagaaaactgtagcaaaagaaatctttttaggatatggacacatacatatatatatatatgcatgcacacgtgtatgtgcatataatatagagattaccacacatactatattaagaagatgcttattttttaaaaaaatacttgacactaggtatataataaattcccagtgctagcaatggcatcaaaatggattgctagcggaagcctatcttgacacaacattttttaagttatccatcaatgtctgcacaaaagaaaatacacatattctttgaaccagcagttcctcttccaggaacctggaactattgatagaattagaattatacaaatatatgaataacagtgtttattaaaccattgtttctagcagcaataaaaggaaaaggaaaacattcaggtggtctatcattagggttatggctgaatatactgcgatacaaacaaattatggaattttatgcaactcttacaaaatgagttatcacagagctgacggaatgtccatcatgattagttaggaagccaaattgtggtgcaatgtaattatttgaaacaatttcttatacaaacaccaccatctctaaaacactatcatgtgtgcacatgtgaaggcctgggaaccgtgggtgtctaaaggaggaggcagtgatggaggcaaggggaaaagatgatgaatgctctcttcacacatctttgttttcattgattacaatgcatgcatattactttttaaataattaagccaaaaatcctaaaaataaggacagaaggaacccacaaatagtcctccaggttctgtttcggcctgccttcttccctagtagaccccatgacagcaggaatactctgaattcagggaaaaaatgaaatcaacgcagcaatgagaaacttgaagctgtctctctaagccctgggcttccatgactatcctctggtcaagttactttctccactaaagtgttctagtcctggtccaggaggtgccctgtacagtacagcccagcagcactctccccttaacacagaaagggacctcagtctcctgtaaggtgagagatgactcaagaagcttcatctctccctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaatgaaaagtgacagaaccatgaacataaaggccctggctgtgacagtgatgaccactaggctttgacaatgataaaactgcactgcctgaagcgcaaactgtgcaaaccctttggggctagtgctccaaagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaacttctgtttaagtacacagacacaaacacggggggcaccgtgaagaaatccactacagagttcacttccagccagaaccacaatttatcgttggctgcaataaactgggggaaagaagaaataagaaagagaaaaaacatgagaagcatggtgctggcatccaatgtacactcttttgtcaaagggtaagttttgagttttcatagggccaccacgcccggctaatttttgtatttttagtaaagatgggatttcaccatgttggccaggctggtctcgagctcctgacatcaggtgatccactcgcctcagcctcccaaagtgctgggattacaggcatgagtcactgcactcggcctatttctatttaatttttaaggtctggagggagacattatgtccttctcatatctacacaaagcacatgcttttatgattggacacacacgttttctagtgccccatagagagccctatatagactaactatatgctatgctagtcttaagagaaagatcaggcagtgtatttttctgtggttcccaacagcttcatagggaagattgggtgattttacttgtattagactcattcatgtaaatataactataaataaagcacatatgtacgcattcacacacacacacacacacacacacacaaaattccatccatctactctcctcaccttcctttcattcatactcacaactgctctctcagggctcagctaagtgaacactgctaaacgtaattttaagagctgaagaggtttatttctatttacttttgttttgttttatttttttgagatggagtcttactctgttgcccaggctggagtgcagtggcgtgatttcagctcactgcaacctctgcctcccaggttcaagcaattctcctgtctcagcctcctgagtagctgggattacagatgcccgccgccacgcctggctaacttttgtatttttagtagagatgggatttcaccaggttggtcaggctggtctcgaactcctgacctcaggtgattcacccgcctcagcctcccaaagctgggattacaggcgtgagccaccacactcagcctatttctatttaatttttaagggaacagggcattatgtgaatagagagatgagaaacaatccaccggtggatacatcatcatttttcttcaatccctatttctcccccttgaaacaaaactgatgtgaattccagaaaatgcttagctaaggagagggctctctctcagactgaaaatcagaatgcgggtgcgctgtttctcctggaaatatcttgactgcgagagcagaggctgagggggatgatccctgggtcccagactgaaacaccccattgtgatactgaacaatgttgcacaaacttacccgcaagccgaagtagagaaggaagaacacgttgaaagccatgtcgatctgtaatgtgaaatctttgtagaaattctggcaggattctattgggctattagacaggaagaagaaaaagcaagaggtaaatgacaggtagtatcatcctgtctcccacgatgctgagaagtggtagtgcttagggtagacgatgaaatgaatattcataaaagaaaacatttggtctttctgcctcctgggatcatcaagcaagcattgccaaggggtctttccattcaaccattcaggaactactgttcttttatttattgttttcgaaattattatatactatcattttttatcatcattcagcagttgaactaagaatctaaagaggatcatgcagataccctggaggaaggacaagcaggagaggcctccaaattccttaatttcatattaacccttaaagaacttctttctttctttgagaggacacatactaaagctaaaacacagttcctcatgccctccaacgcattggcagtggggcctgttttcaattaaacacagtggttgtgttttggaccttttaaaaaccattagttgattaataaattcaggacccaggagcatctcaagaaagctagagaggagaggatcctgggtgaggttctggctagattaagcacagactttctgtgcaggactcggatctggggaaagaagcattgtccgaccagtcaaattcagaccattaaaccaaaaggttgaagcagtactctaagggttaattttttttttttttggcatgcatgctaattgacttggtgtgtgtgtcgagcagccaatgcaaacccctagcacactctacttcaagagtcgccagttcaaaagggtactactatacaaactggtacaagacttctgtgtgctttcctgtgtcaaactgatcagaggatcagtgtgtggaaagtcccaaggtttgggctgggtgggaagtaggaaagcctcataaacactcaaagctgtgaatggaaattcacatagtattctgtgatcagtaggtaaatagtaacacccaggccaggaacgtgaaggtgaagtgaggtgagggaaaggagacagaataccaagagaagcaaaacactttagctaaagggaagcgacagacctcctccctccaggagagggccagcttgagaaatggaagatgaaggatttcctagtagtgccactttggaaatcactgtgtgcaataccagttagtatagttgcacttctgtaaggacaacgcttggctgttcaacaggcaggaatctgtgcagtagaggaactcggggcccacttagaggcagggtaagttagtctgtgggaatctccgatcatgttccatgcactggatttatccattcttcatctctgctacaagtcaaacatgccctatatcatctcccaaatcacgtggaaaaatctccagacaagcattaagagtaacctttatttgcattcacaaactaggtggactgaacaaaaaacaacactgaaaaacagttcaaaaaaaaacaaaaaacaaaaaaaaacgacaattgccaggttttcactaaggtagggaattgggtagaaagacagcatggaatttggttagtccaatgctgaaaggagacacaagcaaggaagccaaatatcacagcctgccatggctctaggcctgctctcctacacaggtactaatttcgatgaaaaaaggaaaatccaggctacagtgaatcggtgatacttctgcaattctcaggccatgggggtgcttgtttttgtttcaaaaacaagacccaaaggtccatgggtgtcagagttcccagccactctagttgcagtgaaaaatgtacaggaactaggttgaccagaaatcctatagactccagggttgaagagacaatgcatctctgcaggatacgttactaaagagtaaatgtgtgtgtgtgtgtgtgtgtgtgtgtgtgtgtgtgtgtgtcagagaataagcaagcaaggatggggagatctgtaggtaactactgtactcaggtgctcacttgtgccagcggggactcacatagctgtgcattataaactcacagtcatcaagattgatgtatacgcagtcaaggggagagaaaaaaagggcttggtttccaagactatcatggaaaactgactattgtttcaccaaggccaaaaccttacagttgccctcacagtcgttattggtggagttactggtggcatatttggggccatcatgagttccctagctcctattaatcccgtggcctctgtggttaatttggtggtaacctagaaatacagctaattggaaaagtatttgctaggctgtggtagaaaatggaatagttgggggagagatgtgagctgaatgccacagaggatacttggattcaacataaatggaaacaggtattgagaagagcataaggaattggctgcagtgacttctccactgtttcttaccttcctggtcctttctgtcatccctcctcataatgcttatgttcaatggccacagtgagagggcttgaagctagaggacatgggtgttgaaaaacgcaccttaacaacacccctggtttacaggaaaccatgttgaagccatacaagaccttttccttttctctaatcctttcaaaaaatttagaaccgatttcatcatgtttcattatcattccttgcgtactagacttggagctgaaatactaaaggaagtaaatgatgccgctggcgcgggtggcttttcctctggctggagctggcaggtaatatgagcatacctcaataatatgagggggcagggggcaggcagagaagcaggaaactctgggacaaaagacccatataggatgagtgatcgggcaatgtactttctatcccttttagctatttcctgcttgccactacagccccaggagaaatgtcctgcctgatttttttcaagtggcaacagaactgtttatcagatcccctctgagataagtcctctgagtgcctgtagtttacggactcgcacaatcagagaccacagagtggagcttccaaatccccattatttcattccccaaatggaaacaacccatggagaagttcaatgatcctttaaaaaaagaatacatatttcaacaacaaaagagttggccatatcaaccaggatttattttcctcccaaagagacttcatcttaatgattaatgcacattataggatggagaatgaaatacaaacacctctcccttcttgtgtaaagtaggaggagtttccttgtctagatacacagaaacttcaaaagctagcaaagaaattgtgctttaaagaaaaaaaaactacaaaggaaagtgactctggatcacacacagacttagatttccagtctgatgaggcatatccacctcagaaggatttacatgggcatatgttgccaacaggaaaaaaaaaaaagtggagttttatgaactgaaataacactagttctgcctctggtagtagaaaactgacttaccctaaattgctacgggttaactaacttaacttatatcctcttaataattagagaatataagatacttggtaagtggcagactattcatttctaggctcccataatccatgaaacaagtgtgatactaaaaccacaggcaaatttagcatgttgaccaggactccatgactgagcaccttcaaaagagcctcagtaaagagttgattcttatggagtaaatgttcagttgtagggtagaggttgaaatacaaactcctatttcctcttggccatcaagtaagtacatcctcagcatttagatgcctctacagaggaaaatgagactcacccaaagtgggaaatgtttctctttcctcatctacttagtcatagaattttcaaaaagactcttgagcaggatgatccaacagaccttcccaaagactgacttaagaacttatcttttcagagcacaaggcaagtgagggctacccaggttttttttcagagggcaggagctctcagcacaaaatctcactgctagcagttgttcctctgggcatcttcctcatctccaagagggaaggatcacccgctcctcacagcctctaaacttccctgggtttcctgcagtctgttttcccacctccctgagtctggctgccgaaccctgtgaagctacttctccagggtagtggttctcaaactttggcatgcagttggagggcttgttaaaatcttgctgggctccatccccagtttctgatttagtaggtttggggtgggggccctagattttgcatttcttacagtttcccagataatggggatgctgcttatctgggaacaccgctttgagacctgccactcccaaaaaacctttcttgcaactacacactaattataggtgttgctgctcgagaagcttcccattcagacctgaacagagatgattcagtgtttgagccagcccccagataaccagctgcctaccacttagctaattgctgggatcaaggggttgaacagacattttctgtttcagatgcgaacaagggggtgaaaaaattaaaaagatacagggaagcaattgcaatgccactgtgcaagcttcaccagtggacgttccaattaacaatcagagagtacctgctgagcacattttagattaagattaaaaggaaaaatgatgaagtacagatggggaggggttacggagaccatcatttacaagggataaagaaatggtaagtagcttaagaatgacaacaacaataacacacacccaagatgatttactagggacgggactggctgaggaacaagatatcattttgtgaaataatttccaacgttcaaattctcctcactcttgtggctagtccctttctaaattgaatggggccctctcaattcccaccaggattatggacaggcagagttcaggcccacagcaccacagacatgagtcaatgcaataagcctaatgattctagactcttttcctagtctcacctctgcaatgttgccaaattaatttaattaaaaatgtcattcatccaccatcacggtccctgcctgtttcatatagtaactctaagcctggctaggaagaatttctaaaacctaaactcattctacatctcttactttattttctactatgtttcagtccaaacccttgccttcattatttcatgaatgtgacccatgtattccctaattttaaatctatgccttctctgtggcctcttcaactgctgattactctttgtgttcaaaccttgggcagtcttcgaggccaacctccaggcttgattcagcaaactacttgtgccctcattgacctctcccatctctgaattcccatgctactgggaggaaaaaaattctaaactgcctcattatgttcatattcaattattcttcaattcaatgtaataatacctgacaattgtataaaatttacatatgctattgcatttggtcctcacaaaatggcagaataaagtagatattgtactataatccccattttacagacagagaagcagaggctcagatatccaatcaagaccctgcagctatgtggtagagttaggatagagacccactagccttgtgccataccacttcctctccagatggagtgcagccttcttggagaggaagaggaagcataagacatagtgtctgctatctacagagcctcgcctggggctcatgcaaaaatgatgggggttgactgattcataaatccttcatagaggaggacaaactgccctagaaaataactgatgtgtctgttgggtggtctaggaaaatgcagaggaagcagatgtattcaacctgtacctaaccctaaccctgctctgtagagactgtcatgtgggacactaataatccccagaagtcctctctgggaccccgtgtggggtggtggtatcaggaagactgatcccatcggctgaggggaagttcttctgcttatagagggataactcctagttatccaactgattaaagatgaatgacccttcaagtggcccaattttccctcaccctctcctattctaggagaacaaggatgaagataatgaaagctgataatacttagacactctgaagactcttaattatgaactagatgattaataagctttgcatcccatttgatccaatcaaaataaataaaaaagatgatatcatatggatatggatttttatggaatctatctataaccaagagagtaggtctaagtgatttgaagctttcctggctacctctggatatcctggataaactgcctacactggaataaaagcatctagccagccagaatattatgagacagactaattttaaaaggaggcaagtctttgcaatgtacttcaaattagaaactgatattattattcataaaatttaagatcacagaaaaatattttgtgagctaataacaataatggatttagtgtgaatgacatgatatgaattcatcattgagaaagcaataatatttatatagaacattttctcctgaacttgggacaacaccccaagactgccctgaacctgacgggatccaagctgaaagctttgtattcttttggttttcttcatgctgccattttacttatcttatcagagctgtgtacctaagagtttatctttctaatatcgattcttctcatgtttacactggacggggcatgtgtgttcaataagttgtgtagtttttagttttaccaaacagaataaagcctcttcactttatcccagacatcatggaatagttatcttctaagatgtggtcacctttgatgggtcagtttgtggtcaatcatccatcaatagtaatgatgataacatcaaaatgggccccccttttttaatcttaaaacatttttcttagaccttgaaatgactctaatgtaaatagaaaacagtttttgttactctgcagtactgatcgattatgatcccatgccagctggttgtttaactggctttactgggaagtcatcagttatgggtttgtatcaacaggactattaatccttttgatggcagcaggcttctaattatagctctgctcagttgaagagatgtgatccaatagccacaaatatatgtattccatgttgaaatgaattggagcataccggaaagtagtataaaaaccctaacaactctttagcatccatatacactctgtattcttgagctttgagtaatatggagactcctgaaacaatgatagcagttgacttcagagcagttgtaaggctcaggatgtctacctgaataattattcctaagagtaaaacattcttctaggagacaaagaaaatgacatagattgctaacagagagaatggaatatgtcaattctttataaatttctcaataaaacacacacagatcatttgctttcaagaaactcaggtggcgagaacccttttgtttgttatgaagttcttttaaattttatctaacaagacttcaatattatatctgaactaagagtctcctttcccatcttcattccatatttcttatccacgatagacctagataggtatagcaaaagcaaaatacgggcattacaagttgacctcaaaagtggttggcagctaggtagttttagaattcaatggaagagctaaagttccagccctatcacctcctagctataggatcttaagcaaataatttgacctcttcaagtctttgttttctcttctgtaaactggggataaggttacgaattcccaacgttgttctaagactgaatcagatgactcagcactcaaaagtgatagtaatttccaaaactaaggtaataataatagtgataatagtaactgtttgtagaaaatgcccccaaaaggcaatcattcaactgaacaaaaactgataggatcaattgtttctatttttttcatttgtatctgctttactgcctctttatctggtgttgcactgtaatccaaatgcccaacaggctgtgcattgggctactgtaagatttcacaaatgcctagtataattctatagagtattaaagaagaaaaagtgaaaattatatttccatgaaggcagccacacagtctcataaatgctaaataattagccaagatttcttgacagagaaagccataagtcactttaatgagtggccacaggagtttgttattctccttttttcctagtttttttttttagagatgagagctttccttgcctggttggcttagcacggatctacataagaggcagagatctgaaccagtcatatgtcttgtaaatatctcttgtaagttttcttctctaagagcacgtactttttcactgttacacttttggaatgatgtccaagacaacctacccactaatgcttgttttctccagcttatctgcagactacaattatttcaatcacagttgttaccagagtagaattagtgttcatatttgccagcaacttctatgtaataaatcagagctaagctactacataaaacagagtctttccaaacaagtattgcttgattttagttttcactaaactgtcttaggaatcatgactgaccaattctactcactcgttccactccctccactgattctagccatcccttttttttagggaacccttatttatctagaaaaggaatgggatggagtaggtgattcaaatagcactaaatgcatatgcacttatgcacatataccagaagacagagtgaaagttcttcgagggcagggtcaatgagccatgtataggtatggagtggttcatgtgggtgggcacccacacaacgtgtacacacaaacatccccagcctcccagcacaaatatatgctctccatccaaccccaaccccactctgggaccactcacaaaacaggacagcctagatgaggtgattagaaatgggggaaaggaaagagaagagaagtcccaggtctgaatggagagctgagaatctagacacaaatgctggcatggggaatggaacctctgacccctggatccatactcctctcacatctacaggaatttagtcctagggaaacaagaatagactattcatgtaaccactacattctgcttcctatgccttttttttctggatattaaaattgccacctatgtgctaggaggctgataaacaataatctataaccagggatagccaacaacccctagccattggggagcaacagcctggagctcacatttctgaaagagagggcatcctagagaaagtagctcagggtacagtttcaaggcacttcatatcaaggcttcccaaataagaagccctcatattcatacaggggatggcagaggctcctaagagaaaagaagagctctctatttgccaaaggctggccaatcagggcacggttgggcaggtaggctggtactcccatagcataacagactgtcaaatcactgtgggacttctttgggctgttactagatgcagacttcaaaattctgtctgagccttctccagatgtttgccttggactctttgggcctcccctggtcatctcaccagtcccctatttaacttatgccttatactcccttttcttgccctcctacctggctttgacatagtcctgtcatacctggatggcatgaccctggcaatggcaccttgctatgggtctacctgtaaggatttggagtacagaagctaaaactattgaatcgacagctagaaccagcctgttctgagttccggactgacagttgcggataatgagatgcctgagacgtatctctttcttattctgaaccttagtatttcagccagtagcctaagaggtctattacagttccaactcttgtacctcttggcacatctgcactcaagcagaatggcacacaagcccctcagcagggcactcaaggtctacactaacaaagagtaccaatgctgaagacttgctgatcctgaatgtaggaagcctgagaacatctggaaaaaaaaataattatgtttaaaaaacagttgttccatttatctgctgcttcactttgacgaacagaaaacaatgtcacataacatagatagtcaccacaaggacaccagcttgtttaaagttacacatgaatttatatgtgatgctgaaggataattataatggcttatatctatttctaacatcttgaagttttgttgttgttgttgttgttattgttgttgttgttgttgaggattttttttaagaacacacagagaaagacctggtagaagtctttctgacatctggcatagaagacaattatacctttattgcacaaggaaataaaatagctgtgtcttagctccgtctttggctgacagctaaggcctggaagttttgtaagttttcctatttaggagttttgttgagagcctagcagcctcacagccaaaacggagtgtctgagatgctgctgattagaagtcatgggtctgctgagtacaaggctagagtcactccttaggaatgtcataaaggacctgggcagtagaaaccaacaccaccatggaaaatcagacaggatgagttacctttaaaacaaactgtcatcattaatagggaaaatggcaatgacttattaacccctatgattatacaatcatatcttcaagtatgcacacttttcatttccttcttgacaacttcatgaaagtaatgtctcatctcctggaacatttcttttcctttttttttctttccttcttgcttctaattaacattgaaaatcatttatttatcaaaattaggtttcccctgcccatgtttcagaaataataaatagctggctgagtatggtggctcaagcctgtaatcccagcactttgggaggccgaggcaggtggatcacttaaagtcaggagttcgagaccagcctggccaacatggtgaaaccccacctccactgaaaatacaaaaattagctgggagtggtggtgaacacctgtagtcccagctactcgggaggctgaggcaggagaatggtttgaactcgggtggtagaggttgcagtgagccaagatcataccactgcactccagcctgggcaacggagtgagactgtctcaaaaaaagaaaaataataataaatagctatttccaccatatcaatgacatccactagatttttgggtataaatttggaaagaaatatgatgaattacctgctcagtggggtgaagtgtctttctccttgcttcctcctgcaggcccttcttttaattttattgtcctatctttgaacttctctagagatgttattcctatcattataaaaacatctctgtgagaggcctaggatggccccaggaagccgatttcttaggattttctcttctgtctctgtgaatggatctctgtatccccactttctgttgggcttcagaaatcctttcattttatgaggaatcactgtgtttttctgggaaagaggaatgggtctctgtactgaagaatctcacaaaagagaatcagatgtttccttcgccaagcccccagatgaaaacgttcataaagtgagaatatgccaacgtgctgggcaggatcgcctgcctgcacaggtctgtactgtaattacatttaagctcctttcaaaaagcgaaatgctcccattcaaaggatctttttactggttaccaaaagaacatgttatgaaattctaagcaaagtccatttcaatataatacatgggatatggttaatagaataggaggaaaaaggactgtgggaagagcttcaatctactaagcccccagattgtagaagatcagatttcatgaagaaaacctaaaaataagataagaagcattcggctttgtttcattctgactgcttagtgcctactcttgggctaagggatgctgacaagctagtatcatcaagaattgtctaggaactgttattcctaccctaggattatcacagcttggaatgcctcgcctttcatttttctcagcttacaaccaaggcatgtctaaaatgcaaagtatctatttgaaatgacaaaaaaagaaatgcagtgagaaaacagatcctgacagttgtgttttataaaagtccattctgagaatacaagaaagaagtatacaagtttaaaaaaaataaggaaaagaaagcagttttaaagtaagtcattagacagccctaaggcaaaaaaaaaatatttcaaggagagaaaatgatcacaatttactaatcaatgatgttgaatgcagtgccaacatgctttaacaaatgcgatatttcttcctagtagtaccatttcatttcttttaaagttgaattaatagttttactaaacactatgaaaacgatcaataattgcatttcctgaggcatttagcccaagaagtgcttttaaaaggtatatctttttatttagatatttgttagatctaagcaaaatcaaatcaggtaacattattcagaaagacatgaaagggtatcatcatcctggtcacttggtgcacacccaggtggagtcaggaacatgtaggactgatgatcaggtaggttgttacttggaaaactggtcctagcttctaattatttgtcattagtctttgctcagcataaacctaaaaacgggagatttatctctctcttttccaatgtcctagtcttgaattttcaagggacatggtggcctttgtgatatcacagcaaactgagggcccacagggatgatccaggagaagcctcaggcccagtgcttcagtgtattggaatgctcgctgctttaattcatgcatgcgtccagtgctcaccacgttcagggccatcggggaaagcacgtcaacatgcttgggcagtgcaggaaaagaatctggttaacctggaggcgacaaccgaaagggggaggttgcatcatgcaaatgaaaaccacagcttggccttagctgccatgcagaaaggacctacatcaaagagtctgcagtgcggctcctgggtaagagtcgatatgagagaggtgagttacttcagcaatgagagacacaggcagaaaaatgttcaaaccactctaaacagaacactgtacagagcgctggcattacacgcgagaagaggcagctttggggacgaggaggggcgagacagagggaaggtgaggacagaactggccgttactcaatgaaatggcttccctggccatcctttcatatgcatgtatttttataatgtatttcacttcaacaaataacctcatgagagtttttaacatcaaccataattgttaagatgttgtgaaaattcaggagaaacaaggcatcagttacataaagatacacaccatggtttcctgtagttacagttcattatagaagcagagctgaagcgggtcagataaataagagacagttaagtgccaacatccttaacactttggttacagagctcatgatgactctcaaggcgtaatgtagtgttgaaggaacccaacagtcgtgaaagctcgggtggtgcaagggtagggactctatgcatctatacccctgaaagccatttataaccctgaagttaaccacgctctcaagtgaagccatcttttcttcatctcagcatgaatgacaggtgaacagtgagctcacctcatacatattgaccatttagcagaaccctagttacgagcaagattctcaaaggtatttcttatcaaaatcaattcatcagcaaaaagcatatatatgtgatatatatatatatatatatatatatttcttaacatttctcttaaaggagtaataatactgttttaaattcagtagagattcatcaagcttcgctctaatgtcaaggctacactggatatctaaaaactagtttcctgtaaactccctgcttaatataaggcttgttatcatttttcttgcctcttctgccttttatgatctctggtacattgaacacaactcaaaaaatggtacggtctagtcctaactcacaattcctgcctcctagttctgacaggggaagagcaagccccgtgcttataaattactccttctaaaatgttctccaggagttcagccttctgattccctgcgtgtatgatggaggccttgatagggaacttaggtccagtgtgaatgagcagtgcactgcctcactttccacactcagtgagaccttaacatacccactgaaacttgagcaccacccagaacatgggagtgaatgcaggtagaagcaaaacacaggattcctcccgacactaccttcctcattccttgagatgcagctgtttccacttgatcacaatttattctctcttatagattaaaaactcagaggcttagttgaatgacatcttttcaaaggattatctttttgaacaaaaacataatagtctgtacattcattcaacaaatgtctctgagtttttttctttggtgacaggcactatgctggttttggagacatataattcaataagacatgattcttgctctggagtagttttccatttagcagagaagtctacccagattttaatttctggcagcagatatgcaagagcagcttgtttaaaaattctactgattaccttgtatgaccttggataagatatttaatcatgctgtgcctcagtgtcctcatttataaaatgcaaataatacctacctcctgaggttgttgagagaaataaatgagttagtaaacgtgaactgctttgttagtggccagcacatgatggatgctatgtcagtggtagctattatgatcagtagtactcaaatataagtaagaagcaaaggactctggaagcagaagatcgcctctgcctaacttttgcagtaggccttgagtgaggattagaaactcatcagcgtgagaaggcaggggaagggatggaagcagagggctaagcttgggcagagagacagaagcacagagaacacagtgcattctgggagtggaaggacacctcgtatagagcctaagtagattgtaaggttggcaagaaacaaggccagacaggagacggtgaagcatctgtgtgccctggaagcatgtctgctctttatcctataggaaatagggagctgacagaagtttatttattttttatttttattaaatctagtttttgagacagagtttcactctgtcacccaggctggagtgcagtggtgcgatcttggctctctgcaacctctgcctcccaggttcaagcgattctcctgcctcagcctcccaagtagctgggactacaggcgcctgccaccatggctggctaatttttgtatttttggtagagatagggtttcaccatgttggctaggctggtctcgaactcctgacctcaggtgatccacctgtcttggcctcccaaagtgctgggattacaagtgtgagccaccacgcccagcctgatagaaatttaaatgctggagagtggtaccattatcttgtcttgtagcaagttaattctggggacaatatagagtaggaattggaagcagaaggttgtgaagacagaggtcaattagtcaaattaaatccccacggaaaaaagtaacctatgcacatactaagatgagcatcattgttgccatataattacagtatcttaatatcctgggaaataccccttcttcagggcctgctgctgtcagagttctttaggaagaggggattaggtccacagtatcactgaagcaatttcctaaaccacatggttctctctcctaccacggcccccatgtctattgcaggaatctgtgtcatgaagaaatgacagcacatgtctcttaatcttctggaaaaaaaaaaacccaccctagtaagaagctgttctttctgctatttggagagcagtctctaaattatagttagaatcgacataaaatgaacatatttcagtacctcaaataggggtacctggacatagtagacacatgccaacaattatagacaaattacagataacagattatagacaaattgtatacatgtgatcacacccaggcacatagaaaaattacagtgaacacttctgctgcatccactattaattacctaaagaacttggttagtcataccgtcaagccatcaacttaactgccttttaagtgtccatccaaccctgtgcacagttaggatttcatgagcatgttggactggttttctctcacagaatcctgacctttagatttagatgtccttagtttccagagggctgcctgaaagtatgaattctggggtgtgcagggggtagggggtgaggctttcttttggcaggagttgacaagaggaaagatgccattttcaggtaatgtgctttctctttaaaaagtgaccaagtgtgtttgatactcacttagctcaattttaaccgtggtgggagctctgtaccctatgttggtaaatcagaaacaggaaagttctgtctgtgtgctgctgtgaccatgcggtcatatttgtttggtggatttccatttgttccaagtccattctagtttggagtttccatgaagccaggccaagtgtacaaatgctaacacagggaaaaagaaccctctatacatggacttacggagaagacaatacacactgaacttggaaaaggagcacaggctgagattccctaaagtggcagccaccttgctgcacagcagacactcagggagatgctccaggcagcaattgctcagcaggaaggcatgctggggaaggacctcatttcaaaggagagtagaacaggcctaagtgctgggattacaggcgtgaggcaccgcacccagcctgaaattagtattattttaaagttcacgcatgtgaccttataaaaatgttggtgcttatttttaagttatttctttttctttttaaaatttggtttctcacaagagaatttcattgtgctgatggaagagttctgtatactgactggagaggtaataaaacaaatttatgtgggataaaatgtcttggatctacacagcaaaaaaaaaaaagtgcttgtaaaaactggcaaaacatctgtacttgagtttacagcagtacgccaatatcaatttcctggttttgataacataccatgcatgcctatgtagcatatagcactatcatggggaaagcttggaaaggatacagaaactctgtcctgtttttgcaacttcttgtgaatcttaaactatttcaaaatgaagttctaattttaaaaaacagttattctcctgtttggttttactgtagccagacatcaggctagtggtctatttctggtgatatgtgcctctaaatgtctacagactgatttctttaacaaacatttactcagcacctgttataggtataatactgtgttcaattccaaaagatataaaagagggataagaaaccacagtgatacaaatcaacattaactatcttagttcctttctcaaaggagtgctaattgaggcaaagacatcatttacctactgcacaaattctcagagacaatcccccaagataatcagctgtcaataaatgtaggtcgttaatgtaataagcaagcttctagaattaacccacagtaatctcttcaggtaagcagatatcaggtaacaagctgtgctgaataatgcaactgatgtgataatgactctcttccttcacgtacagttggtgcaggctaagccatccttttccttagtttttcagtccctgttttgtccttcccagaactcagtgctcaccacactgaggagccaacaagtgatacctgcttaatgaaggtgcagggtgacactaagagctacttagattttaagaaacaactgaaaaggcttcaagaatgaatgtctaattggtggaatttcaggtactttgcaagttagaagagatgttttggagtataggagtatttacagcaccctcaaactcacccaaggatggccatctaccacactctctactaaaataagttgtcatgggcaattatattggaagtaaagtcaaggccaaatgaggcaataaggatggatccttagaatgccaaagactttgcaaggaacatgtcaacagtttttatcattctgagaagctgcctctaacaggaacaaaaagaaaacagagaaatgtgcaaagaataaaatctcctggaattgaagcctcagcaaatgaatatccaggaagagccaattcaatccttcctgaaatagaagatgtgtcactgctgttaacctgacaccgttattacctgcaagtggcttgggcttttaagaagtctggaagtaccatctttttcttgctgtttaaaggataaacaactagaacagctcaatccgggaacaaatgaatttttcaaagcattccccaaagaactgggaaactcctgctatgaagaagggtcctatcctaatcacaacaatttttaaagaagttttgtaacagtggaagacagaagactcccagaaatatttgacatctgtaagaatgaacagcagctaagaatggacgggctgctgcattcactcctctgtttcacacccatgctattcccttgcaagctcttactcatccacctttgaacactcaactcagtggctgcctcctccagaaagcctcccctgatcctcctcccacccagaggtaactgaacctttttctaggcttttcttcctgggtgcttctgttgtggcgctcatcactcatgaagtggtaatttatttgtttgtgtatctgtctcccttccctgctagactgtgagctcctgaggggagagccttggtgttttgtgtctgggttcccatcatcatggtacccgcaaaataggccctcaatacatgtttaaggaggaggagaaaaataaatgaattgagggagaaaatagacaaacctggaggaaactgattataattcaacagtaccaagatactagggaagtcccatctcccaacatggtttcaaatggccccatagtcccataccaattcagaacttaaattaggctaggcgtgatggctcacacctgtaatcccagcactttgggaggctgaggcgggcagatcacttgaagtcaggaatccgagaccagtctggccaacatagtgaaacctcatctctaatagaatacaaaaattagctgggcatggtggcgggttcctataatcccagctacttgggagactgagtcaggagaatcacttgaatccatgaggtggaagttgcagcaagccaagatcacatcactgcattccagcctgggggacacagtgagactccctctcaggaaaaaaaaaaaaaagaaagaaagaaaaaagaacttaaattatatgacaattacatcagttacaatattactacaatccctagaggatgaggtgcattcaaaggactgatttgtgtgctcttcccgtgtttcaggggagtttcaggttatctcacctcatgtgtgcaagaagaagaatgggaatgaccttggaggtaacaagattcaccactcagcaaagccatttgacctcactagccatgagaggtccaagacctgagaaggctatgggatagttaaaattccacaggagagtctccccgagggcattcaatttctgtgtcattaggcatcacaaaatctaaatgcctaaaactaaaaaaaagtcattcctctgaaactaatgagtatgcacttttctccttctatgagggttatcttctataactgggaaaccaagattgaaatgaagttgcccctgtaaacattataaaattaatcagggaagaagaaaggggaaaaaataaattaataaaccaagcttgaagcacattcagcattaagcatgaggtcaactcattctctgacctgcttcctcgacatggtttggtgcctattgtcctagaatcatgtagactctgtgataagatgatagttccccttaagtgctctatagataacaacttgaacattaagaaatgttaagctttccccgtgaggtagtctttcaggtcctgcatacgagtgaaactactacatcagctgatctgaatgaaagaccccacgggtgaccccaggaaggtctgaggaacaccacaagaagctgactcaccaaagaacacaatttccacattctgatgatttaatcccccttcccctgatcagtcaacaaccccaattttccagcccatcacgctccatgatgttcttaaaaaccacagcccagagctcctcagaaagatgaatttgaggctctcctcccatctcctcccttggtgccctgagatagttaaacccttctctgctgcaaacctgctgtctcagggtaatgggtctgttactatgcagtgggcacacaaacttattggttctatatcagaaataatacacagaggtgattgaagccccagttcgttcttctctctttgcttcaaatgatatatttttttgtgctctagctcaggaagctggacctaaacttgacacgaagcatactaggagcaaagctaaaaatctagagatgtgtgcatatcaaataggaggaagtcagctcatgtttctcttgctgattcatttctccaggaagccaacccaaggaatcaggtgttcaagcaacaatggaaaaagatgaattaaaatctccacataagaatacatagatgaagaggagtgtgggtgaggattttaacccaaagggtctccttggagagtaacttatcttactggatataaatcaacatgctctaatttttccagtaaggctgaatatatttaaaccttcaaaaaatatagtaatttttaatgcagtcttagattgatgaaggtttcttatagtttttactccatgctgcatatatgatgaagattccattaggaagtccatctgaaccaagtatttaaatcacttaacattaactttcctttgaatttgtcctctcatatcagcctagattttgataacctgctccttctagtcatcactctccctaaatataaaaccattttttaaaaaatcaggacgactttttaaaagtctatgaaattgtaaaaatttgtagagttatcactagcttctgaagtgacacctctgggtaggcaattctacaaagactatttgtaactatatgagctaatagtatagaagcagtgatgtaaaactgtattatttgtttattatgagcaacagaataatggaatgaattaatgcaccaatctcgctctaatgaatctatggacaacatgacagtatggtgtgaacagaacaaaataaaaccattgagtgggtccatttgcaaataagcccatttccccataaggcgagagaacatttgtttaatttaaagcttaagaacaatctctttacatacaaaatactttttctcagttaaaaaattataagtgctaagacaattaaattaatacagcatcaccatttttaaaactgaaaaaaagaggtttaattaatctcattgtgttctaactcactgttaaatcaataaaagagtttgaaaaaaatgtgtcaacctgacgttggattcattgtttttctatttagtagatatgtttaagaattcattgagtggtgttgtggagtttaaatgagttaaaacaggacaagggcttagacagtcactggcactgattaagggctcattaactgttacctgttgtcaaatgtaaagtcatgcgccaaacttctatctgctcttggtttttcgtctaactgggaactggacctcttgcctctacgtaagtctcctaccacccgtattactctctctctttcccactgagctctaaccatactcatcttctttctgtttcttcaactgtccaagtttttggccatctccactggaatgcaaggcccataaaagcagaaaacatgtgtgttttgttcactgtttcaccaaaacctacacaagtgcctgacacagactaagtactcaataaactttgctaaacaagtaaataaataaatggagagccaaaggaaggaataaagggaggcagggagggaggggggggcgggtcttagttcattctcactaagattaagtctatggtcaatactagtttgctagtgtttcctttatcaaaccatgcttgttattaggatcaggctgctcccacctcacttcctatgtctatatgatttttttgtactcacaaaaaggattttcctctcttgcattccaacacaaggagttccttgacaatttaatattatataatatatgcacctggaaagatgtttgacatctaatttttgacttacacttaaccacatatttccgctttcatttgaaggcaaaatggaacattttcttgtcaatttttttttctagattatgtgaagaagaaattaatagtcttgtcccatgttaatctaaagctcttctgattacataaatttaatagaggactctccctaaacaaactttaattccacacttaaagtatctttacaatgacaaaattgttctgcattctatagatattggaatataacacattgcataatttagaggttaagaaaatggactctggattcagaccaggggttcaaactctagttcctattactaaccatgtggacattgaaaccttctgaggtgttctttcttcatcaagcaaataaagaaaatcgtagtagtgctactaagtagaataataagtttgtaaaaggcttatcatggcactttgcacctagtaagtactcaataaatacagaagctgcttgtagacctagagagagcaaactagaactaagatcagaatcccctaatgatagccaggcaagccagtacctgacctattgaacatctggtagagatccactgagtgaacggctgctactggtgactaactgcatgacagcctttccttgtcttcctcgctaatgtctgttcaggttgtgtggcccttcctatactgatgtgatgtattttgtagaatccctctccttgagcctgtgatggccaaaattgcgtgcataccataaatgcttaactaggtaaaatgcctttgtaagactctgatgttagtccctgctgacaactttctacctcactacaatccactttaatctttgcattgacatttctgtttagaagagcaagccaggaatgatggctctgggctgagaatctggaatgcagattataactgctcagcaagttcgcttgctttgtgtaaactggccgcacttcttttgtcctcatttggaaaatagctttggctgcttgatatcgccacatcttccattttacacattctcagtttctgacaagaaaagtagagagtggaatgccacactgttgcaaatctgcggatacgcatcagcttaaccttatttgttctggtggatttttgtagatgagaatgaatatttgggctacaaacttccagcttgattcccttctcttagttccaatttcccagggtttgtttgctcaaatgcccaatgtaagagcactactctattctaggggccaccttccactgctgtgggttgacctcaacaggcattaaacctgtatgcagagccaggcatggtggcacatgcttataatcccggctccttggaggctgaggcgggacgatcacttgagcccagaagtttgagactgcagtaagttatgatcacacaactccagcctgggcaacatagcaagaccttgtctctaaaaataaataataagtaaataaaacgttttaaaaacctgtgcgcagaaatgaaagcccatgaacagcaaaaaaatcaaatgcaatcctggagctatgcataaaccaaaggagagatgaatatgtctagattaaagttctttagcatctactgtccatcttatgggattccatagacaaacatacagtagaaaagctcaaaataaaatggctttattctatatttaaaactacattttttccttatttgtgttattgcagactattagtttttcatgcacaggcaagagctaaacaaatacactgattccccaatgtgaccctctatagcatcaagacctatttttatagcagtgtaagtacatgcaccaactattatgtgttcttatgaagtaatcctcatcctgtcaactgctgtaagatcctggggaacatgctgagcaatgctggtgttctatggttatgcagtacttggccaagctcagtgggtaatttctcctaagtatatatatgcttaaatggcacctaccaattatctctctttggaagagtgcaagtgtagcatgcccactctcccagatgtgtgcacattcccgcctccacagagctgtctcttcgcctctcctctctagaagctctgggttagtcctttctccaggcacagaggcagctgagtgaactcagcctaggggagctatcactgttcttttcttacctctaggagttacaacagagaaaacctgttctccagaaaaagaccaccctctacaatgtcttcataggaaaaaaaatggtcacacctgtgacacagccctaattgaattcttataggcacctcagatcaaagctacccaataacctgaggtaatggaaaagaaaaacaatagagtatgacatttattcatgtaccaaattcttggtttctcacctattaatttttggtcttgcaaattttgctggaacagaacatgatagagtactggctctgaagttctaggttcagataacaaactcaaaaggggtttaggaaactaatccaagggagaatcataaatttgaaccttaacatggactctgttctccacattaaaatatattgtactaccttttttcatataacatatcaaagaaaccaagagttggctcttcgaaagaatatacaagaatgctagacagctggccagattaacaaaaaaagaagattcaaataagtgcaatcagaaatgacacagatgacattacaactgatcccacagaattacaaaagattctcgaagactattatgaatacctctatgcacataaattaggaaatctagaggagatagataaattcctggaaacacacaacctcccaagattgaaccaggaagaaagtgaaaacctgaacagaccaataacaagctctgaaatggaatcagtaatttaaaaaaaacctaccaaccaaaaaaaaaaaaaaaagtcctggaccagatgggttcacaaccaaattctaccagatgtgcaaggaactggtaccaatcctactgcaactatgccaaaacactgaggaggaagggctcctccctgatgcattctatgaagccagcatcatctttataccagaagatggcagagacacaacaaaaaaagaaaaacattaggccaatatccctgatgaacatagatgcaaaaatcctcaataaaatactggcaaatcaaatccagtggcacatcaaaaagttaattcaccacaaaccaagtaggctttatccctgggatgcaaggttggttcagtatatgcaaatcaataaatgcgattagcattataaacagaattaaaagcaaaaacacatgatcatctcaatagcctcagaaaaagattttgattaaatctaacatcccttcatgatagaaactctgaaaagagtaagcatcaaaggaacatacctcaaaataataaaaaccatctatgacaaacccacaaccaacattatactgaatgggcaaagctacaagcattccccttgagaagaggaacaaagcaaagactcccgctctcattactcctattcaatatggcattgcaagtcctagcctgagcaaccaggcaagagaaagaaagaaaaggcaaccaaataggaaaagaagaagtcaaactacctctcttcactgataatattactctttacttagaaaaccctaaagattcttataaaaggctgttataactgatcaatgattttagcaaggtttcagaatacaaaatcaatgtacaaaaatcagtagcatttctacacaccaacaacatccatgctgagagtcaaatcaagaacacagtcccattgacaatagccacacagaaaataaaatacctaggagcacagctaaaaaaggaagtgaaagatctctatgtggagaactacaaaacactgctgaaagaagtcagagacaacacaaataaatggaaaaacatttcatgctcatggataggaagactgaatattgttaaaatggccatactacctaaagcaatttacagattcaacactattcctatcaaactaccaataacattcttcacagaattagaaaaaactattctaaagttcatatgactccataaaagagcctgagtggccaaagcaattctaaacaacaaaaacaaaaacaaaaaaacaaagctggaggcatcaaactaccaacaaagctggaggcatcaaactacctgacttcaaatatactataaggctacagtaaccaaaacagcatggtattggtaaaaaaaacagacatatagatcagtgggactgaacagagaacacagaaataaagccgcacatctagagccatctgattttcaacaaggctgacaaaaacaagcagtggggaagggactctctattaaataaatggtgtgggtataactggctaaccatacgtagaagaatgaaactggactcttacctttcaccatgtacaaaaattaactcaaaatggattaaagatttaaatagaagacctcaaactataaaatctttgaagaaaacctaggaaatacccatctcaacatcagccttggcaaagaattttttactaagttcctaaaagcaactataacaaaaacaaaaattgacaagtgggacctaattaaactaaagagcttttgcacagcaaaagaaactatcaacaaagtaaaaagacaacctatagaatgggagaaaatattcgcaaactatgcatctgacaaaggtctaataactaggatctataaggaacttaaaaaaattgacaagcaaataatcccactaaaaaatggacaaaagacatgaaatgacacttctcaaaagaagacatacaagtggctaacaaacatgaaaaactgctcatcatcactaatcgtcagagaaattcaaatttaaaccacaatgagataccgtctcacaccagttagaatggctattactaaaaaatcaaaaaacaacagatgctggcaaggctgcggagaaaagggaatgtttacacactgttggtgggaatgtaaatttgttcagccaatgtggaaagcagtttggaaatttctcaaaacacttaaatcagagctaccattcaacccaacaatcccactactgggtatatacccaaaggaaactagataattataccaaaaaaacacatgcacctacatgctcattgccatgaaatttcacagtagcaaatacattgaatcaacctaggtgcccatcaatggtggactaaataaagaaaatgtggtacatacacatcatggaatattaaaaagccataaaaaagggtgaaatcaagtcttttgtggtaacgggaatggagctggaggccataatcctaagcaaattaacacaaaaacagaaaaccaaacactgcgtgttctcacttataagtgggagctgagcactgagcacacatggacataaacatgggaacaatatatactatggactactagagaggggagggaaaggaccgtgggttgaaaaactacctattgggtactatgctcgctacctgggtgcaatatattcacataacaaacctgcatatgtaccccctgtatctaaaataaaaactgaaattaaaaatatatatttttaaaagtactgtatgtatactacttttaattatgaaatgccaatttgttatattctctctctctccttctctccctcccctgctcagtgtctcttgctcttttctctctcttgctgtcttctcttccctcttcctcattaagctgtatggttaaggaaatgagagcaatctctgcttcaaggcacagccaagaggaatcagcgctcttgactttgacatcttcaattcctactaccacacttcgtcagagaaaaaaaatgacaggaaacttctagacaagatgattccctgccattatccttaaagatctatccaaatcacatcattcctttcacttgctaattggtttcgtaagccttcttcccttccttatgttttctattcttatttttgggacaattgccgacgtatgcatagttctggattttttttttaagtaatttgtagttgactatcgtttatttctgcaattggtgtaattaaatctaattacataatcggtgaaagactgagtaattacataattagaatgtgcaataataacagttgaaatcctattgttatgacgtgtaatgatacaattatgatgtataacattcacagggtactctgcaacgagcaaaaacggctctaaccctggctgaatggagcacagctaaagttggagacctggaaagtagctttcagcacctatacttggacttgcttatcatccttatccccctaatgtatcctttgacttttatactccacaggaatcaaaggcagtaggcgaggtctaaggaaggtcctcatgagggcaggagcactcacatctccaagaaccaaatcaccaatacaatcagcccttagacagaaaggagcagcaagagatggactcacatttctgaaacagtcactcctgcatgtcagttttaagtttgaaactgtaatcaggagacaaaaagttagggttggagaatgtctggtgatcacacacacaattacaagtgggcctagtgattatggcctgggacatagctcccagctctcagtctgccctctccaccccaactccagtcatcttaatcaccaggacatagaccaaccaccagaagtgctggcctcccaggtccttgctctgctgattgtcggtgaccctttcctttcctccacgccacccacccactcccatgatcttgctctggacccgaagaaagcagcaactatagtgtttctgatatctcggcctcaaacaccccattcatcaacagcaacctctcatccttgtgctcgcctgttcacgtgctccccactgggacccttccccaacctcagagaaatctccaaattctggacacctcccccgacatcccacccctggccagtcatctgctccctgccttgccttgcaacgctccttgtccagcctaattcccatagtccaccattgtcatcacccctgggcagcaccctccttccataacagaagccctcagccctacttcacaccagctctggaaagctgaaagttcctgaataaaaccacacaagggaaatgactggtttcgctttaaattcatgatctcaaactgcaaattgacactccatactgactggcaaactgctatttttcttgaattggtttgctttccaattttccaaggccactatttcacagttttccttctctcctccaacctcccatgttcttttctgcaccatcaggctcagtggatggcctcgcctcatcatgtcattaaaagtcacataaaagaatcaggccagttacactttttttcctaccagcagctctccaacactgcacttacaggcgcccagcacatcctctgcctcttcattcataacacaccatgccctccacagacactctttcagccctgtactgtctaactgtactgtgttgctatagcaagctctcccttgctgctggagctctgctgccaaaatataagcttgctcaactgtcctccatagccaaccacatttccagagactactgcaggctccatcctttagcccactttgatcaggccctccctccactcactagagcttcaatgtcaaagaaaccagcaacatccctgtcacaaactccacagatgaccctagacccttaccttccctctgtctcaacagtgcttggcaattggccactccctctgcctgaaaccctctcctccctaggcttctgccatctccttgccctgtgtgtgcccttcctcagtttcccatccagcctcctcctgctttactcaccctctaaatgttgggcatcctcttgccttcacctggggcaccttctctcctctccctacactctttccccagatggtaccatcaactcacaggcattcaaagtcatctttgtaatttccaaatgtaatatgattcctctcttctgagttctggactcaattatctaccctgctgtttgacatcttctctttcaggtgtcacagacttcttaaactgaacatatccaagatggaaatcctgatttctccctagtgcagcccttagcccccagtgcagcccctcccttcccagtaaatgctaccaccagcgacttgtcattgaagccaaacactagaaggctagaaggaccctgattcctccttccattcactccacatccaattcatcatggagtcctgtccaaaatgtctttctcctctttaatttccctacttcaccaccccactagatcaggccagtgccctcttctgtcgggatggtcttttctttatcttctgaacatgattacagattgcacctgttttgttttgttttgttttgtctgtcttttatttttgcttttttttttttttgcctgtctcctcctctagactgtgttccctgattacatttattgttttacttatttacagtttccagcatagatcaggtaattaactttcattagataaataaataaatgactatggtattggcatctataatatgcagactatgagcctcatggtaaacttataagggccaagatgaaagccagggccagagcagagataataaacttagctgaaagctactcaaaaagttaaacatcgagataccatatcttgatgtgctatgaactggattgcattcccccaaaattcatatgttgaagccccagtccccagtgttatggcatttggaggtggagcctttgggagataattaggtctaatgaggtcatcataagagtggggccttatgatgggattaatgtccttgtaagaacagataccagtgagcagtgagcttgcccctcccccccacctgtctctctctctctcctctctcctctctcctctctctctctctctctctctctgccgtgtgaggacacagcaagaaggtggccatctgcaaccctggaagagagccctcaccagaaattgaccatgctgttgccttgatcttagacttcttagcctctatttctatcttgaaaacatcatgctaattgaaagaaggaagtcacaaaaagccacatattacaaaattcaatttatatgaaatgtctagaacaggcaactctatagagacagaaagtagatgagtagttgcctagggctgagaagactgggggactgggagaatgtggaatgattgccaattgatatagggtttctttcgggggtgttgaaaattttctggaattagattgcagcgatagttgcacaaatctgtgactatactagaaaccactttaaatgagtgaattctatggtatataaaacatatttcaataaaactatgaagaagaaggggggaagaggagaagtgggaaggaagggtgagagaagcgggaggaagagaaggcaaacagcagcagctcaaattagttaacctagctgagttagtctatggaatctaagttgccaccaacaaaaaagtaagccactgctttatatgccaccaagaaagaaaatatttaccaattatagccataagaagtcatgaatgatgagacacttcctgattttggagattttaaactatgaaaaaattgtatcttagaattagtaaaatacagtacacgtagctgttgtcagatctaggtaccagcttctgaaggcttctaaatttgaattacttctttaaagataatttattaaccatgaactcattcattcataagaaaaaattttatcaaatgagtattataagctggatattggctttatatatggttttgactctgtgcacatcattcatttaatcttcaacaactacccttcaagataaacattatattcctcattttatagataagggtgtgggctacagaaaggtcccatagttcttaagtggcacagccaggatcctaagccatgtctccaggtctctgctctgtccctgtgttatgaatgaacagttcagatgcagaaaccttgtgagcaaaaactgaatttttggccaggtgcaatcttaatcgctcacgcttttaatcccagcactttgggaggctgaggcgggcggatcacctgaggtcaggagattgagaccagcttggccaacatgatgaaatcccatctctactaaaaatacaaaaattagctaggcatggtggcaggtgcctgtggtcccacctactcgggaggctgaggcaggagaatcgcttgaacctagaaggtggagattgcagtgagctgagatcatgccactgcactccaacctgggtgactctgtctcaaaaaaaaaaaaagaaactaaacaaacaaacaaaaaaaaactaaatttttttctaagccaaatgtttcctctgtcagctttagagatgtagatgcccatcaatcccatcatctcaggccttacttctcacatggccaacttctcccaacatcaactggtatgtattaaaggaataggaattacagtacatttctggagaatattcttggccaccctggaatttcctgcattcaatatgttggtttgccatgaagtctccaggagctgccgaatgaaaacatggagatacttacagatgacacagacagaacaaagtggaaaatgagaaacaaaaggagaaaaaaagtggtatgaagtgcagttgcacctcaatttatgctgcagatgctttcttgaaaattatgtgtagatcaaattgatttatgaactaaaccctatcataaattcaacaaaagcattgtgatggaaacttttgtaatcagaaaaatttatttgtgctgagaatagttgattctcagcctctcttttgaatttacttgttattcttctcaaggggagcctacctgcacataaaagttcgataaccaccagggattcttgatgtgcaggaatgtcatgagaccaaaatgctttacaaaggcttaaaaatataaactatctatgccatttataatagccatttccataatactttaaatatatatctcaacataatgggagggttgagaagatccttctcagggatggaattctaggaccactattgaaggagattatttgcgtgggtggggaagttcagaggagataagtatctcccctgggtaaccaaaagccctgaacccttctctcttgacagttgagagggagggagaagttgaaggagtccagcactccatttccaaatgactcccatggcctccttgcaaattacaacgtcactagctccctggtcttccatagccaaaggttacaaaatggccacccatacaggccatttaaaccatttaaaccatttaaaccatttaaaaccatacaggttttaaaaatcaagtgttacatttcttaaaatggatttgcagaattacttgaatgaataaaagatctgcaagacatgctccatattcccactggggaataactcactggagctgggtagatgctcctgaagacgtgtctcctggtccccactacttcttaagccttgcatccagcctggctcctgcaggcattttcacttgcaccccagtagaagtctcctctgagctaagggtcaccaccacacgactcacccaatcccatgtagagcccgcaaatatccatgatcccaagagcatcctttctttaatgtggtctcatttcaaaatatatgagactgttggatttatttatttactgatttatttatttattgagacagagtctcactccatcgaccaggctggagtgcagtggtgcaatctcggctcactgcaacctccgcttcctgggttcaagtgattctcctgcctcagcctcacaagtagctgggatcacaggtgcacgccaccatatccggctaatttttgttttttgggtagagatgggatttcatcatgttggccaggctgatctcaaactgttggcctcaagtgatctgcccgcctcggcctcccaaagtgctgggattacaggcataagctactgcgcctggccttattttttttattatttaataaattttttagagctagcccaaattctttcagatcctctgttcttgaagtgccctcctggttcatttcgtctagtgacaaatatgactccatatcaccactttcccagagaatcagcacagcagccatgcctccagagcttttgcttcacagacatgcttaataaattcactttaccctttagaccacagggcttagaaaggaatgttgtttttgttgttgttgttattgttctgctttccatcagcttaatacaatcgtgacgacatgcttctaagaaggatcctaagacgttcatttctttgaagcactattaccagtggagctgacaacaaaaagttaatagacataggactcaggcactcaggctcactctgcttaaactagcggagtggggaagaagagagacgtgtacattccatatccataccagcctggggtcttgggttctaagaggggtggtggcttttccctgagccctaaacccagcagctgcagttagtgccaaagattatgagggtacagaaagtaaagaaagatcagtgttttaaagtctccacccaccatatgatttctcagaaacctcaaatgtcctttgttgttgttgttcgttttgttttgttttgtttttgagatggagttttgctctgtcgcccaggctggagtgcagtggcgcgatcttggctcactgcaagctctgcctcccgggttcaagcaattctcttgcctcagcctcccaagtagctgggactacaggcacccaccaccacacctggctaatttagcaacctcaagtcttaatccatataggaactgtaagaagactactggtttgtttctcatcactaacatggtaactcatgattgccgaacactggctgagcagtcatgctctgcccagtggcattgttttctaagaacttaagtgtatcttctcattatcctcataaaatccccattatcagctccattccacaagtggagaccttgaaacttagagagcttaaataataataataactaaaattcatgaagggtgcccttctagcccactacacataccaggcactgttctgagtgtttttatctgttgactcaattaatcctcataacaccctttttgtgttactatttatgttgtcttcatattacaaatgaagaaactgaggcacagggaagaggtgaaataagatcacttagctggtgagtaattaggcagaacttgaacttgggcagcttgacaccaaagctgtgcttttactgctaggctgatttgctcaaagtcacaccactggttaaggctggagtttgagtctactccatgtggtcagaatctagagccacaggggcagccatgtgctctgcggcctgcttagatgttcatggggtcagatttcctctgcagtggctccaacggctggcagcagggtctgggatggatgtactgcctttctcagagctaggctgggaaaaacatttccttgtcatttattttttaaatgtcaggagattttaaaacttctaggagagcagataagtgataagaagaaaatctgggtcgtttttgtgcatacaaaggggccattctaatagtggtttcaaggggtcttttctagacaaaaggggaggagattgttttagtagccctctcttcctttcctggggagtttgaaactatctagttttgaaatctaaaaatccccaagctcttggatctggtcctttttacccccttagccatatattccagtttctgctaaaaaaagtctgcctcaagatataagtgacatccaactgttggggctgttttctcttttcatagaaaccagagcttctggggttctgagatgtctctagcggtcactgacctaaccattagcaactgggttctacaaataatgtccctggggaactcaataaaattatcaatcgctagcccccacaggtcttaatagagagtggataggtggaaggtttataaatcaggatgagtcatttgattcaccaagggaaaagataaataaaccaacactccaattaattttaacctgaaaagaaactgctagtgaatggtgcgttagccaagtccgtagggtcttaacaaccttaattattcacaaatgcaaattgcttttactgcttgctaatttcttcatgtcttccatccagttcctcttcccctcaccatcctcctctctcctcacccagtctctttattcctgaagagccaaaaggaaatttctggaaatgaccttctaatcactcaagctttttctctaaaaaaatttaacgaatcttcccaagaccctaattagcttaacctgggatccaaggactgccctaggcctaaataatccatagatgcgcttcagggaccccatgagctagctgaaattatatgcaaaattgtgggggtgggtgcaaaaaaaatcagaaagaatgaataagacctactatttgatagcacaagagggtgactatagtcaatagtaacttaattgtaccttttaaaattaactgcaagagtgtaattggattgtttgcaacacaaacgataagtgctctaggggatggataccccattctccatgatgtgattattacataataagtgcctgtatcaaaacaggtcatgtatgccacagatatatacacttgctatatacccgcaaaaattaaaaattaaaaacaaacaaaaaattgtgagggtagggtacttcctggctccctgcccacccaagaggtccaattttcatcaaattctcaagaaagtctatgttctccccaaccccctaaaacagcattaagcattaaaggactagactgtacccacctaaacactgcatcacaaggaatatttatgatgcagagtgagacagcccaggcttaggagccagacagatgcaggttcaaatcccagctctgtcacttacgagctgcatgaatttagacaaatgtcaaattctctgagcctatttcatcatctgtaaaatggtgatcataactccttcagtacaggattattgggtgactatacaaaataatacgagaaagcacaaagcatttgtacatagaaagggcaaaatgaaaatcctccctacaagagagagaaaaaaaggcagatctaggctcaggagtagagacgctgctctcccatctttgggaactgcatttctggctttgctaaagatgaaggtcactgtactacaaagacaatcagattgggatcacccctgggaaatccataagaatcagattggaagagcactctttatgagcatcatattagattataaacctttttatagatcttatagtgacatgcccaatctgatttaaaataagcctctaaccctctattctcctactgtctctacctactactcccaacataatgtgataagcaaagcctaaacatttcaatcatgtacaatgtgaagttgcaccacagtaagggcactgaaatgacctcaggaagcccgcatagccagatgtctgcagtccttctgcaagatcccaatattttcaggttctacctgggtcagttcgctgctctggggtaaatatcaattagaggcttctagatcctttggctgttgggacttccagaacagcatcaatgacttcaaaaacatcctgaagtcgattaatctgctcctgttgtatgggctagattcctgattccagagaacaggccaacagaacgcaggccaagaggaccccacctttgcatttctatttctcatggcaaggttgcctcactcccagaaaaaagaactttagctttattatctgagacaggcagaggattgaagctgattgccattctctacatatctgattttatattatgattgtattgtggggcatgctactgcagagtttaactgcattgaaatcattatatcatttctctttggctataaagaattttaatttggggctgggcgtggtagctcacacatgtaatctcagcactttgggaggctgaggcaggcagatcacaaggtcaggagttcgagaccagcctggccaacatggtgaaaccccgtctctactaaaaatacaaaaacttaaccgggcatggtggcaggcacctgtagtcccagctactcgggaggctgaggcaggagaattgcttgaacccgggaggcaggggttgcagtgcgctgagatcatgccattgcactccagctctgggtgacagagcaagtttccatctcagaaaaaaaaaaaaagaattttaatttggaagccattcatagtggttgtagtttttgctcagaccatgttgtgacacacagtgtattggcttttcagatgacattaacccagccacctgctcatcttggtcctgctcagttaacctgcacatctgtatttttgtctttaaagtctttattatcaacctcactccccagctataaaagctgtttgtcccccaaacaagttgaaaagaaagtgcagaataatcagagtgtatctagaatgaataaaaaatgagaatcccatgacatccaagatgggatacagtcttgattggacatacagacagacatggtgacagaaaactcagaagccgggagggtcagagcgatggagcttactagaacacaagttcattttctcaaatgtgagtgttttgccctctctgattggcatgccttttttccttcctcaattgtggggcactgtcctctaaccacagatgacttctttacaccgcacggttgcagatagcacagtttcaaggagggtgtgcttggatctggtagaggtcatggacgaagtgaagacaaaagtgaagtcttggtggtactggttcacgcaaggaatcaaacagcccaatgagtcagagatctgctaagtatatggaagccttcatgacttaaaatatccaactgccacgagagaagttccagaacagaggagcctcttccagcatggacccagcagctacaggagggctcagattgcttgctctgccacgcctctgccatctgccccctgctgaagtcaggccagggaagaggtgctgcccatgagtcagccattctcaactgctgcttctgccttctcactttgccatatttgctccctatctgggatggtacagttccacagaccctgatacacctggggttcagcagacctaattagccttacatgtgtctgctcccaaaatagagagtcatttattccagtttctgtcctgatcagcaaggtgtgacctaggcccatggcccatagccccagactgggagaggagccacattccttctgaacagtttctaaaaaactttcagtcccaaatgagtgactttagaagtggagttttgaggatggagctgagcacgtggatttcacatcttctcctcttttcagtatagctctcaagccccctggatgcaaaggcaggaccctgatgaacttgccttttctatgacagtctttacactacaagaaaggggctgcaggacaatcccagctcccaaagacccagcccagagctcaggaaagccaggctgcttctcaccaaaactgaaaaccaggacaccttgggaacactcaggaccccactcaggcaccagctccttccggcagctcttccttaccctgctgaagtgctgaccatccctgcccttgactcactcccattgcagtgccaactcagagcatctatccccaaagccagagtttctgggattcagatcttggaggtgtcacccattccctatgtgactctgtgggagctacttagttaatctgcaccctaatgtcctcatccatcaaatgtcgatgatgacagcacccatctcacagacttgggtaaggctcagaagagctaatataaagaaaatgcttagaacgtggactagaatagtaagcactcaacatacttcccatgctgttgttggcgccgctgctcccacttgtcagataccatgtgagaccaggagccccttgaaggtgggaaactttttctgtttacttctatggtcccagcacccagcacagagcatggtgcagaaaaggctcaaaatgttttatgagtgaatgaataaagcgaatccagttggcaatgctggactatatacagcttgacttggtgatggttaccttacagactcctcccctgcaatgttctgaaagagggcagaatgtcaacgggcaggcacactggccagagagaaactgagcaatgtgagaatggccaggggagactgggcattacagcaaaaaagactggcattgaagctcaccaactgggttgtcttgagcacatccatttcctcttgggcttcagtctggccatctgtgtgtctaaacaaaggcaggaactactagaaagatggggtatcatttcagcaagaacaggtggagaggtgaaacatgactcatctttctccacctgccccaggggactcccc[450 bp omitted]ctctgagtaaacaatccaatgatgctacccacaaaggccgcagatccaagcttaggaggcatcttcccgtcaatgccctgggggcccctgttgccaagtgacatgtgtctgtgattgcagaaggccctattctcccagaatctaggggaggaagggggactttatgcagctggaaaaggcaaattctaacagtcctttgtgattttagacatggtatttaatctcttttgaaatgccaaataatattaaaagagggcatgctgcttttatgatttttcaggaagggtcatggactaataacaggttgcaaacattgcaacattgctgggagggttcttgcccttgctgtaggtacatattgctgttctatttataaccaacatgaaaacaatgtaataatcagaactaagagatgtatacatccctttagcctacctatttttcttggatctggaatattttgggcctcacttgttgatttttagcagcagttgaaaggagctgaccaaatgcacattaacgagacgacattcctgtctctttctgtcttcactgggagacgtcctatttgagccatcctggtttgagatcccagcctcccacccctcaagcatgagacagccacgagaaggccccctgcagccacaaacatttgtcagagtgatttggtgaagttcagcagtgaaagcaatttcttactcggaaaatcatttatcatggatagcctgtcgaaaacaatctcatttcaaacccttcccagggagaaaagaactgacaactggcactaagtaatctacaacagagccatgggagtcattcatctttcctttgcccagcccaggacttgatgctttcagaagagaagtggaatcaatcataactgctctgaggggcttcaggtaaaagaggagggggctaccgggacagccacatactcctgagtgcacaatgggagattgttcagtctctattttactaatagccaaaaaccagaagagtagttgtaggggtctttgagggaggtgtgcctccttcattacaaaacatgttctttttgtacttttagctcatcttaaatgccagaatcctccttcttagggagcaattaaggaaaagcttattgcttttttatataagctgacttcccctttgcctggggcagtcttttctttgccagaccatagcatggagcttgtggcatagtagataatgattctgtgcatgccatttccactgacatcaacaccctggaaacagaatatctagcaatttgaggctcatggagaaaagcagaagagggaaaatttttccccattaagttccctgcttttttaaaaatacaattagttacagataggaaaagcaattgatcactttccttactgaatgtctgattaaacccaggttctggttttgaggttcaccaagccccagaagaagctaatgaatttcagggctccatcattctcatgttttggcattaaccagtgactcagaaggtactgccagatgcaaattatgacatcaatgctatactccctgggaaccaaataaaacagaaccacctttgtagatgggtagctcccaccagttcccagaaatatttatattatggatattagtacttcattagtacttcattattataccaatcttaactcagaaataaatcaccaggtttagcacatatgatgctttaagataaaactgtcctcaaactgctttcatttctctgtcattatcaggggtctgaaatcctgactattttggaaagaagtgttatgctattttgcccaagccaaatgcaggcattaacggtaaagttctgggataaaatgctccatttgaactgaattgttcacataaaatggctaatttctattagccatttgggagtacttctgccacttcccagctgtcactttaagcaagatactttagcctctctgtgccttggtcttctcatctgtaagaagggggtaatactgctacctaccctgtaagatgttatgaggattaaatgaggtgatacttacaagggccacagcgcctgccaaaaagcaagcatttaatttaatttttttttttttttttgagacggagttttgttcttgtcgcccagactggagtgcagtggcgcaatcttggctcactggaacctccacctccagggttcaagtgattctcctgcttcagcctcctgagtagctgggattacaggcacgtgccaccacgcctggctaatttttatatttttcgtagagacggggtttcaccatgttggccaggctggtttcgaactcctgacctcaggtgatccacttgcctcggcctcccaaagtgctgggattacaggcgtgagccaccacacccggcctaatttaaaatatcttttagaaaactctcagccagagatgaattagggggtaagccaaccactcggtttcctggtagccaatctataaagtccccaggagatcactggaaaagtaacaagatggaaaaatgagattttcagggtgagcactcactatacatgatcgagaagagcactataaaaagccaggtgtgaggaggtaaagctcccataaggacaagatcagagataaacaaagagtctctgaactgctaaagaggcttgccagggtccctgagccacctctacaacagttttcttcctcctccgcttccccaacacaaaggttagtttctctgctaaataaatattgaatacttacataacaaatatcaatttgaaggcacataaaattatgagcctgcccaagtgtcttcttggcctaccatgctctgagctaactggggcactgagtgtaaacactctcccggctactgctttgctctttccctccctcattattcaccacattcagtgaacagaaattccagcttgagccacctgtagtcatgtggcattggtccaaagccctcactaccatgggcgccaaccctaaggggaggtatcctcagcactcactacgtgaaaacctactttgcttgggaccaagaaaagaataattcagcatgaatacgacatcactggaacttgttagtgttatttgaaagatgtggctgaagttttacatagggaatgtgtgcttccatcacaagtaacacagtgtatacaaaactaacaaagcagtttgtggccaagaggtttttgttttctaggatgaataagaagtccatgttcttgaaggaacttgaggaacaatgactacttcaagtccaccctgaaatatggacacgatggaaaagcaaaggtgggtcatccacctgggaatctctagttcaatggttagctcagtaaatcttcccaatttaccatgcagatccatctcccttaaccccataaactgggctaaagaataaacatattgcaatttgggtattaatttaatcaggcatgattttgcagagaagcccatggcaaaaaaaaaaaaaaaaaaaactttctataatgaggtccaataccaaaaatagtagtaacaataatttaaaagcagattgtttaaaatccatctcttcctctctgtttctatccataattgaggaggaagagcatttgttcagcctactgtctgccaggcatgtgccaggagcttcactcatctcttcaccccagtatattattgctgttgtatggatggagaaaccaagatttgcagagattatcacctgcccaaggctaccttcctgggaagagggagatctggatttgaaccccacctcggtctgagtccaaagcctgtgctcttcccacattgtgctgctggccatccctgaagctgccgctgtaggtggagcatactccctgagacgaaccaagggagtagtggctatatatatatatatatgtacacacacacaaagcaaacaaacaaaaacaaaataagttggcgaggatgtggacaaattgcaacccccgcatgttgttggtggaaatgtaaaatggtacagccattgtggaaaatagtttagtgattcatcaaaaagctaaacattgaattcctaaatgaccctgcaattccactcctatgcatataagaattgaaaacaggaattcaaacagatacttgtgcacaactgtttattggagcattattcacaatagccaaaaggtagaaacaatctacatgttcattgacaaatgaatggataaacaaaatgtgtggcagacataaaatggaatattattcagccatcaaagggaattaagtactgatacgtgctacaacgtggatgaaccttgaaagcattatgtcaatgaaggaagccagacacaaaggtcgcaaatatatgattccatttagatgaaacatctagaagaggtaaatccatagagacagaaagcagatcagtggttgtcagggcctaggaggacagaggaatggggagtgactctgatgagtatggggtttccttttgggtttacagaaatgtcttgactaaatagaagtgatggttgcataacattgtgaaggtacgaatcaccactgtatcgtacacattaaaatggctaatagttacttttatgctctgtgaattttgccaggattaagaaaacaaaagagtggtaaagttagaagatatttcacaagttctctattgcactgcattctttgtggatgaggaaaatgagctgtcagtctgtccagtgcggaattacatagctaaagtttgccggtgaagttggggttagaagtcaaccctctgtcaattaatttatcagagcttgcacccaggctcacactggggctctggaggaaaagaagaacaatattgagagaaataattctttctcaagtgtaactgagagcctcccagttcctgcctctttggctcaaagctcatattcctgggaagtcatcctcccttccactccagggaaaatggcttcctacttttatgtgaaaaggagccacaaagaattcagcatcatgaaacacccttagctctatcaatagagaaatttctgtcttcaagggaagtccacttgatttgcttctgcttgaagtgaagcagataacctcaatcaacatctgattacttctttaatttccagagcttgctcattaccgaagccacactgtctctagagaaggacctagagtaactcagattttaacacacctgggctgacaagttacttagcttgggctttaattgagaaatcagttattttacccattattttgctaacattatcaaaatcctgtgatactcaaggccctgaaatgacattttcctctcctttatcatttgtacatgtgactaggagaaaattatgtgtgatggacatgtcgaagatacataagttcttgaagagattctttcctacttgctctactcactgatccgtttccactgaacaaattgagtatcagcatgagaagtcacaaggcagggggttcattctttcttccctggcttggctttctaaagcgtgtgagttttatattgttgcttttcaagatgtgaagttgtgtgtaaatttgtgtgcatgtatgatgaatatttttccctgctaaaaggtacaatgaaattgatagtgaaactttgcaaaccaactctccgataagcttctagtgtttttcttttttttaggtttgccactaatcctcccagcatttctgcagattgtaactgaagctcagcttttctaggaggaaaatacctgttatggtcaacaacctaagagtcactcttgattcctctccattttcaactaaacagctgctctgtctgtgacgcctccagcatgtgctcacaccccaatggcctcggacctctcccaaggcagcatcctctcagttgagacctaagaaaactgcctcccaaatattttccttgcttttgtctttccctgaactctattctccacatcacagtcattatttgctaatggctttattgagttctagtttctacaccatacaattcacccatttgaggtttaaaattcaatgggacaatcaattttaaaacactttcatcacctcaaaaagaagccctgtagccttcagctatcaacccccaatctccccacaagcaaggagtcagtaatctattctctgactctatatatttgcctattcttgacattttacacaagtgaagtcatatactgtgtgatcttttgtgactagtttcttccacttagcataatgctttcaaggtacacatatgttgtggcatgtttcagttctccattcctttttatagccaaatggtattccactgcataagcacatcacattttgttaatccagtcatctgttgatgggcatttagattgtttcgctgttatgaatgttcaagcgcaagttttgtgtggacatgtattttcatttctgttgggtaaatacctaggagtggaatgtacatgtcatggtagctctgtctttcagtttttcaggaattgccaggctgttttccaaagctacagcaccattctacatcatccccacgagcagccacaagggttgcaatttatccatatccttgtcaacacttgttatgatctgtcttttcaagtatagccatccaaatgggtgtaaagtggtatctcaccatggttttgatttgcatttctctgatgactaaggtgttgaacatcttttcatgtgcttcttgactatttgtatatcttctttagagagagatgtattcataaactgaccatttttaaactgggctgtcatttcactttctttgtaatgtccttccattgaaacacaaatgtttttaattttgatgaggtccaatttatctactttttcttttgttgcttttgtgtttggtatcatatttaagaattcatggctaaatccaatgtcacaaaggtctaccccgtcttctctcctaaaagtttaaatgtttttgctctcacatgtagatctttgatctattttgagttaattgatgtgaagagtccaattttattattttgcatgtgcctatctagttatcccagcaccattttttttttttttttttgagacagggtctcactctgtcacccagactggagtgcagtggcacaatcacaactcactgcagcctccacctctcaggctcaagtgatcctctcatctcagcctctcaagtagctgggttcacaagcgtgtgccaccatacctggctaatgtttaaaaaagaaatttgtagagacagagtctcactatgttgcccacactggacagcatcattaattggaaaaactattctttcctcattaaatggtcttggtattattctcaaaaattagttgactataaaaactggatgtatttctggactctcaattctattccactgatctatatgtccagaatgactgtttaaaagtggaaattgcattattactctttctaaagtaatagcctaatgcccaatacaagtcattctctatcccaaggattcttcacttggggccatatacttccaagaggtccttgtgcagtactcagggagtccatgatttggaccaaaaaaattacatctttatttttattaacctctaattcaaatttggcatttcctttaattatgaatatagcaataaactgtagggagccaaaggcccatgggacatgaccaactcagcattccactggaggctatatgatcaaacagcaaactgtttatcgtgaatgcagaatgtgagcaaactcaggactgcgcatgcctccaggaggtttgctaagggccaggaggtttgctgggctccttaaagttatctactgggaaatctagtgcctattgtttgaagaatgcagtcttgcaagcctgctgtgattcaaactgctggccgacaaccacctgcccctttctcgttatctcttttacctaataaattcggaggaccgaaacagctcagggcccttgtccactagaggcgaggtgcccccaaccccttcttccaaatatactctcttgtctttgacttttattccccagttagccccactttgttcagtccaccagggatcatggcaggttacaagtggcaccccgaacagtgacagaatcaggtgttctacaataaattagaacagtattaatgacacttgtaactttttttagcaacagaaatctcagatatttacatataagattacaattgttacaggtatctcaaagtattacttatattaatcctactttaaaatgatggtggtatattagaattattgctggatcttcataaaaatgccctaatcaagaagcaagcagactttatcataatttgttttttataatctgataactgattttaacataatctattttcttataatccaatgtttttatattatgcctttataaataatatttttctgagaaaggggtcatagtcttcaccagactgccaaagaagtcctcagcacaaaacatttaagaaaccctgctttttccattaccagttttattttcttcccagcacatggcatcaactgaatttatcttatttacttgtcaacttgtttacggtctgtctctttctgatactggaatgtaagtgcttagggcttaaaatagtgtcaggcacataatagccattcaataaatatttattgagttaattacggaatcagcagcaattttctaaacaagagctaaatcattggcttaatgaaaataaagactactgataccaaattagtgacatgtaatccatactgaaaattattttacatttatgccatcatcatcattagatttaataaatgccagcatgtcctatgtgctgtattaagtgcttgatgcacagtatctcattcactattctccatactaacaaccaagaatatcattaaccatacttacagttaagggaactaagcctcagagaggttaatttctcactcaagttcacatagctaacaaatgacagagttgggatttgcaaccaagcctacctgccttcagagtattgatttttaactacaataaaacacttctaagagaggaggaattttcttcctgttcaactgagaaagctaagatcctgtgaagttaagaaatgtggcccagaacgcagagttcagcagagatttccaataaaatgttctttccactgttctccttatgagccacagcaggaaaaccccttagcagaactgggtgctatcaggttgcctcctacgagaagatgaattttggaagaagcataattaatactagcaggcattaactgaagcctgttcttttctttcctggggtccagtctgcttctctaaatattagggcttggcctcattcagggcattaaggacttcattaggctgaaatccaagttaatttgattgcacaattataaactgtccctggctggaggttgtctcatttgccaggttgcaagggggcagcatggctggatgacatgcttttgatccccagcttgaagtttcagtgctttctggctttgacctcatcaagttttacagaaaggaagttaaattggagcagggagacagatattctccttactaaagttgtcacgggcacacagaggaccattcatcaggtctgcaaagaaacaaggcacaggaaaagtcctggtcacccggaggtggcagcaaatgagatctaaccaaaggtccattatgcccaaggtcactcacccacatggcaagcatacatccaggctgacccctttcctctttcctgtgcctcattttccccttactggctaacaggttattcagcccgggtatgcagaggagccaagggaaggaataaatcgcttcgttttcaacagggattttgttgacattagtagaatctggaagcatccacttcatggagtagcattttcctctcctctgctattcatgcaagtgatcaaaggacccacttccagccttcctcaagagaggcctctcctccagccaacaaagtcccttcactgactatttttgtaaagacattaactttgcccaaagagaggcctggccttgtcctgagcttctgggaggcaatgtctaagcccttggagtgtcatgcctgataaaagtgtcttttccaggggtcttgggctggccagatagtaacagtgttattttgggtaggggctgaccatgccagaaagtctaacaatgtcatttatgatggaggctttgggttacatggtatccatccacctccaggggagcaggggactgaggctggccatgagggcagtcattcaagtttacatgatccagtcccagtaaaaactttgaactccgaggcccgggcgaactttctcgattgacagtactccttgcgtgtagtcacacattgatgctgggaggtaacacgatccatgactccacatggaggagataatgaaagcaccatatttggatctttcccagactctggcctatgtactttgtcctttggttgattttaatctgtatcttttccctgtaataaattgtaaccgtgagtataatagccttcagtgagctctgcagtcctatgcattatcgaacctgaaggtgacttggggaacgtgccaaacctgcagttgatgtcagagggaggatggtcttggggactgctcaccccatgcccctcttctgcagcatccaaattctacccatgccttgggacccaactctagcctgccatccttccttaaagttccctggattactgcaaccagcaagtatgctggcttctacactaaaagctagtgtttcttaaacgctttttagcaaattccacagtaagaaacagagtttacgtcacaaatcagtacatttatacagtatacatacgtttatacagtatatatacatttatacagtacatagatctatatatgtaatggaaacaaaagtttcataaaatcaaattgaacttctctagctatatttccatcttgggctgatcaatctcatgttttatttatttatgtatgtacttttagagacaaggtcccactctgtttcccaggctgatctcaaactcttggcctcaagccatactcttgactcagcctcctgagtagctgggattataggtaaaagccaccatgcccagctgtgtcatcttttttaaatgcttgtttttcctttcacaaaccatgaatgagttgagattgcagttttcagaagcacaggtctcgtccattattctgataaccgatctctttactgccttacaatacatcttattttgtttcttaacttcactgtgtttatatctcatctctctcaagacctgattaaaagtttcaaaacagacctcaaaaagaacaataccaataatatctaatactttttttggtcatgttcaagctgggcactgtactaagagcctttccatgcagtgtctaattgtttccacacactactatcaggtaggtattatccactatgacatctctcatcaccactttcaccccatgtgacaaaggaaagacttcatagcttggaaaggttaactggcttgcccaggacagctacaaagtagtagagccaagtaagccaagaaggtctggtctgattccaaaccctggtgttcaccactaggctccttcctccccactttctttttgcaaaattgtttttttaaagacagggtctcactctgtccctcaggctggaacacagtggtgcaaccagggctcacttctgcctcaaactcctgtgctgaagccatgctcccacctcaggctcttgagtagctgagactataggcacataccaccatgaccagctaatctttaaaacattttccagggcctcactacattgcccaggctggtcttgaactcctgggctcaagtgatcctcttacctcatgtgagccaccctgcccagctacattcccacccattttcattccccgccagagctgcccagcagacctttttgccccagagtggaaagggcacagatgacaaatatgaatatacaattctggcccagtgggctcaaagaggagggagttggcaatgtttcctcttcagccagcattcttttcaagcaaagctctgtgaccttctacccgaaggcagcgctctcaggcctgtctgttgcggttcccctcactcatctcaggagagtctccttccagaatgccaggcacccctgcctgcctccccactgcctcgccttccctgcaccaattaaactgtcacagtcggctggcttggaggcaggtgaggtcaggaagaaatctgaaggaagctgggaattcagatgagatgaggcctccttgtgctgaagctcctcttctgttttctgtcaaactggtctgaagactgattggatgagcccatagagatccctggcgactctctacactcacctcttcctctccaatggagggtgagaaatacggccttgtacagaagtggcagcttttgcatctgtttgggtacccagtggtccctagttcctggtgcaacagcagtgggtctcgggtggaatgattttggctggagattgtttgcatcctggaatcattgcctaaagaggaatttgtcctctacaaacaagtgctaacccacaatacacaagagaagcaaatcaaagagctcttaggcttggcctaatagatgcatcttgtcttacctaccccttttagtgttgtctgttattggaggaagaggtaggaagcccagggcctccctcccagagtttccttagcatcacctgtcattgttgagattttgaatgcattgcaggttaagggacacttgatcaagaagggaaaacacagcagagactttcacttagacatgttttgtatgtcatgcagggaaaagttcccagtcaacctctgcttaaccttcgggtttgaagatggccctctggcagtcacctgatcttcatggcagaagaaacaggagtgaatgagcagatgaatccatcttaagagaatagaaatccttagtttgggtttcattgaccaactatagggtacctggcaggcaaaatttttgcagctttcatccaattcccaaatgggtgtttgacccacaaaagaaccaccaccagtctacatggtaatatacatacattgccttctataattttacttgctgtagctgccaaatcttattcatacttcctccaagcataagcacatgcatgcacacagacacagccgccaaatgcaccctccttgtctactcctcagcctcacctcgtacctgataacagattgtactcaaaggcactggaagaccacatggctgcctggagcacctttcaattattaatgctgttctttaaaggccttgccttattatttctactcatgctattatgaagagggcaaactccttaatgcactcctgtgccacttcctcccactgctagaggaaaagcacatgctaggtacagtcatctaatagcatccacgttattttcaccttctctgcacactgtccctgcagttctctctggggcctcaagatcaattgtatctcaaactgggccatgggttcattttctgcattttctggcatggagtgagggtagcgggtgtatggaaattccagctctcaaattacaaggtggcaggtctctgcatgggtgtgatgagcaacatgagataggtatccttgttaaggacaactgcattctagtagattccaccatcagaggtcctggagccctacctactatttcttcctgagagtgtcctgataggtaaaaggtggtgtgagtgtcttccacggggaaaagagactgatgaggcagctctactgaaatggcagttgatattaatagggccatctacttcctactttgaaaatatctgagctataagctcagacgctacctatcactaactgccaaatttccatgaaaaagggtcagtgatgaagttgtagcctagacttgggaccatgtctcaggggaaaagtctaagtatgcctccgattttgttttggaagggacgacaccgtaagaatttcatcagtaaatattaaatacaaagttcagcaaattgtgaactttagggttcatgaaaactaaagccaggatttatccatgtcaacctgtaccttatacctacatatgctagaaactaaatcaagtttcatacaatgtgcccatttagctaagtaagtcagaggatagtttccaataattactaacacttacacacttagtataatcaactcttctttggtcaagttaatatcctggcagaacagacagatttgggcctctcttcttataaaaaaagaatctgacaatttaaggggcatatgttcacttccatttatgtcctggaaaatatgccctgtgacttagcaaccatgttttaaaagctcttgcagttcttaaacaaacagagtgtatgtttatgagcttctaacaacgttattttcagagatgatgtagagttagtgatatgtagctctggggcttacagtaagctgtagatgatttattggtgtggcatacagtatttgcctcgagaaaaatggaaatttaagcagtgtttgaaaatgtgttagatggcaaacgacccggggcaccctgagaccaaaggcttcccatcttagagagagaaggggtcctttttggcagatggaggagcaagggttaagaacgtttcctggcactcagggagcacagccaattcaagaccagaaagagagacagtttagaatagaggctgaaaacaggaggcccaaatctggcctgcagaggtgttttgcttggcctgcaagtactttaagagttttggatttgaggccaatattttaaaattggagattcaacataaaatgcagtattctgtctcctctttgaaacacaggaagatctggccactagagcctgcatttctgcataggaacaatcagctggacctgggaagccacttcaggtgaggcttcagctctcattgcagtcctcaccagatccgcctcactcatttccaatgtctgcccttccctgtccagatgaatttgcaaacatcagatgaaaaaaatgttattttgtactgttgcactctcagcgaacagatctcttaaaccagtaagactcattgtcagataaaagaatggaaaaggcacatgtttttccaaaactcgggagaaaagcaagactattaagttgtcttaaaatttttgttgtatccattgttttgaatgctgggttgctgaagttcctatttcccaaagccaagttatcagacagggcttaaaataaaatgcttattttaattttctcatttgaaacaattagaccacattgaaggggtttagtataaggcatctgtctctgagcatgttttcttatctgtgaaaatttccagaaggatggggctgttggaaagggagaaataaagtcaatttctccagcaggcagtgcaggcacagtgcctgaggccactgtacttatgggacacaaaaaagtctaaattttaacttctttaaaatcagaagaaaataaatataataataaatgacgaataataacaacgaatccaggctgggcacagtggctcacgcctgcaatgccaacactttgggaagctgaggtgggaggactgctagagcacaggagcttaaaaccagtctgggcaacacagtgagacccccccatctctacaataattttttttaattagctgggcatgatggtgcccagctgtagtcccagctactcggaaagctaaggcaggaagattacttgagccctggaggcagaggttgttgtgagccatgattgcaccactgcactccagtctgggaaacagagtgagaccctgtctcaaagaaaaaaaaaaaatttgccagccatggtggtgcattcctgtaatcccaactactcaggagactgagactgaaggatcacttgagccaaagaggtcaaggttacagtgagctatgatcatgtcagtacacttcagcctgggtgacagagtgagaccgtgtctctaaaaataatagtaataataacaacaataataaatccagcctggattatattcattcttataccaatgcagccgcaaaatataatatttaatattcttatggaagaattggctcaacaaagccaacgtacctagagtccatggaaatcacagcacggagctggaggcaaatgctggtcttcaggccaacaaccatgcccacactgtggcctgtttgcgagcagcacaagctcattttactgcagactctcctccccatcatgcccctgtgatgctctgtatgtggcaagttcgtaacaagacccctgcaaagcacgtcgcacactgacctcagtttcaaaaagatggagtggatgccattcagatgcttctggaaatttccaaataaaaatttccaaaagttttaatcatctatcattggacaacaggtattactgccactggatagagtccgcttctctgattattttatgccgtccctgaagcattctcaatccctaatctcagtagctgatttcaaggcaaggttttgcttgactttagcgtatactgaaaatcacaaagcccgagtacaggccataatgagagtcttctcttgtggactcctagagttgagggcagactgagttttctgtctattcaactcaaaatctcccctacagccaaaacatgttatagcatccagctatcttttcaactcctcaaccttcagcacttactgtgtgcaatgctcatattagtcattgatatattgcttagcgatgccttacttgttcttgttttgttatcttatttttcctttatatatggctggacttcctgccccttgtaaaaatatgtataatttaaatgtcttaatggaaaagatctagcattatacataagtactcaaaattccccagtacctagcaaaatgccttatacacagtttgtactcagtggagagctattatctgattggtacctttaaggccacaggtacacagacagctctcagcctcatctctgctactgtgatgagcctggtggccaattcccccatgctcttcttctccacttaatttttaggcaggacataattgtttcctacacacacacacacacacacacacacacacacacacacacagagtctttctctccctctctctcttttctcccaaattctatgaacaaagacatatgcatcaaaaagtcccaagggcattgttgctttgagagttctatttttaagccacaaatgactcatcaccaaccagggtctccccaaagctacatgtgtcaggctgtcaggtcaaaagacaaggggtaaaagacaaggaagagttcacatctcctccagcccatgaaccccatgataaagctgtaaaagctgccaccactccacacaccacaccacacccctaccacagttgtgttaggcacaagcactgcccttgtgtttggattaaactgttctgagctataacatttcgctccagctggctcctatcctgatctctcagcagtctctgaatgcatgtcagcctgtgactatagggaaaggcccagtgccatgtgacagggaggagatgcagccctcttgcggtataaactcaggcttgttgtagaggacagaagtaactagtgggctagtgggtctgaaagggaatgcatttcttcatttgccctgaaacaattattcttttaaaaagaataagagagggctgagagagtgccaggttgtccaaagcattctttttaagttttggagagtggcgagaagggaagaaataattcatcctaattttggaaggcaaagtagatagggatgtatagacatagttatcagatagtgtttccacaggggaaacaagtgagcaattgggcaaaatgtcctcaaaagttatgcataacaaattccaaacaggccaaaacaatgtgttcagctcttcaatgcgttcagccctgtgttacccttccacagtggagctgaactcttaactcttacccatccccaactccatgctgaaacagtacaaaaaagagagggagacagtggggagggagagagagagattagtaggagggtcataaaatcaaggaattcaaggcctctcaccagtgaggatgaaataaactaatcccacgcagccacctggctggatttgatcttttccacctgggattatctttgttctttcccatggccctaaagtttcccccatgataagggcctagaagtccagaattggcataaaaagacaatatatactttgctattcaatgagtaggttatcatgtctttgttcatttctgtatttagtagaaagaacccaggagatcaagtagaaaaggactgggagagaaaagttctatcttccagctccagctctgcccctggctggtcggatgaccttgaggaggtccctcatcctcattcctcaggaaaggatgctgaggctcagagaacagtggcaccagttgggatccaatgcctctttgactctaatactatattctacagttgtcttttgtggcagacctgaaaggttcagctcagtcctcctgtcctttcctagcatagtccctgatttccccaatgaaagccaaagataagcagttcccttaatgcttctagatgccattgcctacgatgcctaggtaccacttgtgcaatgacaaataagcaaggaagacaagatttcctcaccaatgtggaagggagaaggaggaagggtgctaatgctctgaactttgacgtaaatgaaaccaatctgtttgacaaccaaagaacagatcctgtccccaaaatctacctatatggagacaaggacatataaagaagttgactctgttccttggcatactctccacctgtcttctctaccaggctttcactcgattcctgaacaaatggcaatatggaaggtcagatgagctaggaaggctgagttagagttactctcatatcagagcaccaagtgttgctattaaagggtacattctgaagggagacaagacttcccattggagttatttacagcctctttgccctgaaggcatcttctcttccaccatccctgagtgggctcggctcctctaccatctgacattccattctttcaacagctgctggctctcctgttgtgttcccttcacagatgtgcagtgccgttctgaacatcctgcccttgaactttccctacccataattttccaaaccaaagcctggcaataaaaatgtcagtgagggatggagaaaactggggggagtattttaaaaggaaaaaaaaaaacagggaggtgctttgcacacagtgatttgtgttgacttcttcaacaaaggttaaatgcatgccgtgacttctcaaaaaagggcatgaaggcagacagctggagctaattttccagaacactacctagaaaggctgtatttcataaaggaactggttacagagtaggctggtgagcttccttttccatgtcacaggctgcccatctcatcatgctgcaggatggggtacactaaaggggatagtgaaagctggtatacacagtcctttacagtttaaaatgcgctgtcatgaatgggatgggatctgtgctgtcctcacagctctcccaggtgcctgtcttggggctgagcacaggagaggcagtgggtctacacctgtgcctagtcagtttgaacaaggctggagaaggaagccagatactttatgacatttcaaagacctccatcctatgtggctccattctttggggccaaattttcctgaagtccattagtttgataataccaactctctgggcatataaacattgcataacataatgcaaaactataacaaatcaactaattctgtaactctctaaaagagataaaagaatgtatctcatggggaaacagcatttctcatatctatttcagtatgccaaatcacaaggacagattaggtaaggataggaaggccaaagagtctttctacttggaaagacacccctaggtggtggaagctaatgaggaacaatcagctctccttgttttttgttcatttgatcctatctcattgcaaaatgctgccactccactgagataacagagaagctggtctcatcaagccattattaggaagaactgaatcaaggcccaaacagacatcagacagcacctgacccagggcagtgtcttacatggaaggcctgtgataggagcctcctacgtacccacaactgcacacttggttctcagggtgagaaatggagaaagggagaacaaaagagaaaacaagaccagtgcattggcaggatgaggtgatgcaacttcccattcttgcaacatctcattaaaccccatcagttacttacacaatctggaaatttacttcttgacacttagaagagagatggctttagaatgagccatgctggaatctaatcctggctctactgcttactagctacatagcttgggctatgcctgcagcttcagcctcctcatctgtaagtgggaatagtaatacctatcctaagaagttgttaggggaattcaatgaggttgcatgtgctatttttggtaaagtgcctagctctgtagctcacagacagtacataatcagtgaatgttagttccctccaacgacttgccctctcttcccttttgaaacagaatttctaggccaagggatgagagaccaggctatgtgaagacaggggagggagaaactactgggcaactaaaccagttctgctaaagctctggacatccccaatacatcaatggtgccagttttattttcagagactatgaaaacaatctggtcaatttctatcgcaatcttaaagatagttttccttaaccataagcaattttactgcctggaaaatattcagcattatcacatttgaagatgttacaaactaataaatgaatacaaaatgaataaatgggtgagtggatgcaaaagtaacattttaaaagactggggagaggccattttccaatcgtaaccccactgttgccttggcaattgtgcccttggatgagatgctctacaaaatttgtgctgccatttcctgctccttcctaacgtccatatccccaaaacagcagtgctgataccagaagccaagagcaaagactggcaaaatcagcaagtgcccccattgtgtgccagccattttggagcagataaagtcattaaggaaacatttaacaacgtataacctttcagctttactctgcaaacagcaggtagcttccctttcagagacaagagcctgcattgaagtcaccagtgagcaggacttgaccttcattttcagtatacgccacattaaatattcataatccgcgtaaccgtagcataagaagtagcagcgtttaaacatgaatcaaaggaataaatatcttcacacatgtgagtcatcctttcccagaatgcccctggtgaaaatgcaaatacccagagctctgggcctctgtctcttccaactttctcttgaaattctgaaagctacagggactgctgcattatgcaatccatgaatctcgctctcatgctgacactggtgggtctttgttttttttccttatctgttagataagaattgctgttcttgtgtcaaagggaggaaatagacaaggatggaagcagcaatggtgacattagcacccacagggcgtctgcaggcactcttgacttggttgtacaatttctaaaaaatctttgcttcacaaggatcagaatatgtgggaggacagggttggcgttggtgtcgggagacatcagaattaggaactaaagtgacgtgtgacataaattgggcaggagtccttttaaaaagaatgcaaaagaaagggagctttttgtacacaatccacctcgtgtggctaattggagatctttggggagatggtgtgtggagggctcaatgcttgtctgtgcttgttaaggcactaacatgatgtctgaccaaagactcagtccagaggcatcttcctctgcttgggtgtttctagagagtctactgctgggatgataaagcataattttagtaaggtttaacgtaattatctttggttttcaattccaggagctctgaggacaatctgtcttagccagatagtaatcacttgcagctacacaaatgagtcttccctcacaaccaccctaggttcattaagatcagacccaaagaaaacgccctatgctgggatctgtctttgcctaatggccaaaaatgaaaggtgtgcagctgtctttggaagtgacttatccatcacctctggatagtaaaaagagctttaaaaggttaaaaagatcataaaccaccaatgatgacctttctctgagctgtattgctaatggacagaagtaaaataactacctagcctgcttgtccacttgcacaactggagctggcctgcctcgagacatagctggtccagcagacctagggagcctgttttatacattaatcggcattccttgcacttttcaaagggctgggtgcagagagcctggaatctcaaacttgtgctacaggatagtcctcagcattctggaggggaggggcagctctggctaaaattcactgagacaagccatttcacgcatgtctgttggtttagattcacttgtgggaaagcctatagactgtcccctgattcatttatttgaagggtgtaaatactagctacaattcatctggagaattctgggtgctttttttccagggtgatgatttagtataacttccacgagaagtttaaagctgtctttccaaaatacccagatggccagccaaaccatgaatgtgtaaaactggtaacagttttgaatgaaagacatggattttaagaatgtacattctactttctcactttctttccatttgcatcttatatgtggatagaacttcatttttttttctcattcactaagctcgattataattttttaataggtttcactgtgttttattcctggaaatctatggacttaccatagagatggctttagagattctacactaattctctcccaaactaaaactgagcttgcttgccgtctttcccaaggaagatggaaaactcccttgtgctgaatccactgattgggcctgccaccggacagaatcttcggatatgctctcagaacaaaatgaagtcatgaaaatgaaaagtttctatataaataaccagaaggtcttcttataaacaaagccttgctatgccaaatcacacagtttagcaacagagaagaaaggctaaagctgggatgaggctacgacagtcctcaggcagaatgggaatagccttgtttctaaccttatgggcatttttgccaggaaaaggtgaggacaggactgaagttccatccttgggatagactatttgcaagttcataaaagaaaccagaatcagagaggactcccagtgccatcttcgccaaggcctagaaggatcacaattaaagccaaaggacattgagatggtgtaggacattaggggaagagggtgcattggggaatttcattccttttcatcttctcacacggaaacagagaacaccaggatctacagaacaaaagactgcctcatagtagactgtaaaaaaagacacaatccaaatccatctaaagagcattttatttctgagaaatacagagggacaaaaggttaaaaaaataaaaaaaataaaaaaacgaaaagggaaggaaggtgctggctgaggcatctggacttctaacccatcaacacactcacctccacattagggttttctttctctgggacatacaagcttcaagcccaaacctctttcctgagtctcagcatggaagttggcagggtctgcaccccacgacatgtaagaacacccctggagagagattggagaaataagaccaggggctttagaggatcttcagttcaatacaaataggatccagaatcattaacagtaaatatttaaaagggggcttaccttcaatgacatgccaatgggagtcttccaaacttaaacaagctcttctctttcttggctcgggagagctgatggagggagcatgtggaatcttgtctcctgacagcgtttaaaggactctccatctgagatgggtgagggcagcccagcctcgcatgtggggtgggctgaaggacctctgataggcttaaacttggctgattcccagagacaggttattaaaggagatatttgctttgttttccctgactgacattttggcctctccacccaaatgcacaaaatccttggccggtgaccagatggctctgagaaattctgagtttagctgtgcatgaaattaccaccatcccaagccacaggaaaggagcactaagctcagaattcaggcacaccagagtctgagccaacaggcacaccaagcaggtttcctagtatcaaagtctagtagccaaccatgccagggatagagtttaaagttcaaaacactcacacagtggacaataaaggcaacaagctcaaggccattgtcaccagagttgccaagttcacgccacaacagaaaatgagttagactccagcttgtttcccagatgccatcaacttcatgatttgcaatagtatagttggaacaaattatttcctcagggttggcacctgcaggaatcagggcagaactggctgcaacattgcagttctagtctgtgccctcttcatccttctgcaaggtctttatcatctgtcacccaggctcactctggagcaccagtccattcggctggcacccaaggagtctgcatgagtgtccactctagaagtcctcaaatggccagggcctccacctctgggggtcatgatgaactcctccatccatctccttaccttcacaagtcaagaagcaccagcgtgcaatgcttcagctgaatacccgattggcaggtgaaaggatagcatcatgctttctaatctgacctccagtaagatcaaagcattggaaacccaattgagaaaaggatcctacaaccatagcaagaatggctcagaccctcatctgtgggaaactgtcaccctcccagaagttgcaaattcccatcaagtcatcttaactacttgacatcttcagtgcaaatacatcattaggaaacagctctttaaaaataagtaatacccagcaagaagacttgacctcatatacctcaccctcctatgccagcagactcaaaatagccttccttctgagaactttctttcccatttagaaaatcagtacagtacagcactagcttcctccaaaatcttctgcactcagaaggtcttgcaaaggttggtgtcaaggtaaataaatggatcaatgtaaaggctcatgattgtttatgaaacgagggcaagaaagtatatttgaatactcactttgatgaatctatgaagtatattacaagtgcaccgatgctgagagcaaagactaagacaacctgtaaaagaagaggagaatgccatcacttaagagttggacctcaggatgtttgggttttttgacacataccgaagcagctttgaaatacggtgcccattgcccttggggacctgcttggaaatctcaccctcatccccagccccccattactgcttcaggtttggctcttcatacagcaatgggcagcaacctcgctccttgccaataggggtcagggtagccttttatgtctcagggcactgggtttttatctgaccctgttatctcgaagtccagcttctctgcaattgtagttgataaacttcagtgggaaaaaagcaggtgaaaatttagggtgatacaatttttaatattatatgtagtctaggatctgcaggaactccaatagaggaatatcaactttaacagcttcattgaggcataatttacataccacaatattcacccatttaaaaagtacaattcatcaatgactttagtaaatctactaagttatgcaatcatcactgtaatccagtttcagaacattttcatcatcccagtaagatccctcatgcctgttaaatcaatcccctttcccatttccaagccccagaccacactaatctactttctgtcactacataagagataccaatttgaagatcacaaatttgctcgtacaaatgtccgtgtgtgtatgtgtggacatacataaagatatattcactgcatgtatgatctatatgattagaacacttctgaaatatttaggaaagtagttccagttcaggaagtcaattaggcaatccattaggccagttatgtgacaatccttgtcctactttacactcttcactcaaaattaatctccatggatggaagacagttttggcatctccttcagtggatacctgtcatgctaaggtccatagaatgaatatgtagcagattaggctgacactgacacttctgtcctcagtacacattctactttctttaatctttcacagaggagactattaatgcaaataaaggatagtcagaaataaagaagatgctttcagccaacaattaagcctgagaataaaaagtaagcaccaccattacacacaatgcctggctgctaggtcaacctttccaggtatgctaataccctgaagagactgcaggctgaagggcattggaagtcagtctcctcagtgtccatctattgacatctctcaggccttggctggtgggtagagaggaatcccaatttatgtaaagactaagcatgatcaagctttgtgtgtgtgtgtgtgtgtgtgtgtgtgtgtgcgggcacgtgtgcctgtgtatgtatgagagacagaatctctctcttttacacccacccacacacacacacactcctgtattttttatgtgtgccaaagtggctgacagaaaatgaaatctgcatgagatactcatttaaagcattgcaaaactgcatggagctcctggggcagaatggtggcttgcacagcccagaaaatgaccattaaaaacaattggacactgtaaaaggaatatgcagtttcatagcaactgataaaatctccatataaagggaggtgctaaaacaatacaccactgaggtttatttcattctgccatttaaaaaaaaaaacaactaaaacatgctccaattgaatgctgcagtctatcagtaattatcacccgcccagcactaatccctcttagctgcctcacctcaacccctcccatcacacatattcattcatatgttcctttcaaaggtacacacaaaaacaagcaaacaaaaacatgagcaggccttcgctttttcctctattatctaaaggaggcagcaaaacaaaaagcttaagattaattttgatctgtgctgctatttctgaggcataagcagttagatcctggccctgacctcattctcaaaaagctgcaaagagaaggggtgtggccagaacccaggagaagggcctcttctccattcataaacagctgatttaagactaatccctgtccatttggctccctgtgtgtgtatctgtgaatgctgagcatctgtcagagctggctatataggcctatgccacccaaagccactgttgcagaaaaggactggaaagaagcccttgcaaatggcatctacatcattctgtaaggaactcaaaatctaagacccctgcaatggcaatgatttcgcagcatccagatggccaatgtagctgatcctaatttgctccagctgcctccacttggagtcagtgatggggactaatgcattccttatttaagcaaatcagccagtgacaggaggaggccaggaatcctgctaccctctgaagatgaaaactcaaatatcagcatctctctgatagggtaagagagggaagaaatccaggagggaaataacctccacagctccctggccctgaagactctgttgaatggacatgcatttgggtccacgtattcagctggaaggcctcctctcaatgagatacaggataggcaaactgccccatgatgtacgatgaaatgctccctggggagatgatctgcctctcagtattaaggtaactgtgcacgtagtcttgaaacttgctaaatgcctctttatcgtgtcaggcttgatcacattgtcagcccagatccaggtgctgcagaaaacacatcaatactttggatgtggccatgaaaatagaatccccatcagagacttgtcttctctaggcccctagcaaagccaccttagaagtgtcagtttagtctctctctttctctatctctctaacaaatccccattgtctgagaactctaagtttgaaaacacaaaatgattacattttagtctgcatggtaatggtattattatagagcaccccaaatagtcacctaagtatttaacatatcctatacataaggcccaagaaaaacagaagatgggaggccacttggagtcatgaaatatactcttttttttttttttttagacagatcctcgttctgtcgcccaggctggagtgcagtggcgcgatctcagttcactgcaacctctgcctcccaggttcaagcaattatcttgcctcagcctcccaagtagctgggactacaggtgcctgccaccatacccggctaattttttgtatttttagtagagagggggtttcaccatgttggccaggctggtctcaaactcctgacctcaagtgaaccacctggctcagcctccccaagtgttgggattacaggcatgagccactgcacctggcaaaatatactcttttttatagagtcattcttctgtagattaatcccatgctattatgcaattagtgataaatcatatagtacaggtttagccaatataaaatgaactattgcctagatggatcattagtaactgggtaaagatagaaaaagtagggcccttatctcaatatcctctcctttcccaaaatgtccttcctttctacatagtaccactactctaatatctcttcacgaagggctgaggccattgggaatccttttgcaagcttctatagtttcagggacaaggaggacagaagcccaagggacatggtaaaatgaggccaaggaaagcacagtaccccagaaagcaaagcatccctgccctacagcagctgagtcatagaataagacaataaccaagcatgtaacaaagcattgtcccacacaagggcttgggggcagcagtgtgatacacagataatttgagcattgcctcttagggcacttctgctagcttgcttgagagcctgtcctggttgctaaacttgccatagtctgagctcaacaaattacctcagccatcttggacagtatgaattgtcaccttctcagatttactgaaaacacccatatactgtgtggagatattgagtactcggtgtgccagattcctaaaaacaaaagcaatttgataaatgtcattggaacaatggtgtttgagtcatctattttcaaaactccaagatcaaacaagacatgtgtttgcacaaaagaatgccaggaacacacatacacggtgtatttttttttaagggcagggtgcagtggctcatgcctgtaatcccagcactttgggaggccatgacaggtggatcacttgaggccaggagttctagaccagcctgtccaacacagtgaaaccctggctctaccaaaaaatgcaaaaattagcagttgtggtggtgcacacctgtagtcccagctacttgggaagttgaaacaggagaatcacttgaaccctggaggcagaggttgcagtgagccaagagtatgccactacactccagcctggacaacgaagtgagactctgtctccaaaaaaagcaaaataaaaaaatataaaagtgggctgggcatggtggctcacacctgtaatcccagcactttgggaggccgaggtggggggatcacgaggtcaggagttcgagaccagcctggccaatatggtgaaaccctgtctctactaaaaatataaaaagttagccaggcatggtggcgctcacctgtattcccagctactcaggaggatgaggcagaagaatctcttgaacttgggaggcagaggttgcagttagccgagatggtgccattgcactccagcctgggcaacagagtgagactccatctcaaaaaaaaaaaaaaaaaaatctgtccctaacacctgatgcaaagaaggagcctggtgcaaaatggggaggagagaggggaagtccatagccatctcgctagatgaaaatcccggtggaccatgaagatctttcaaatgtctgacaaggttcatgaaagttcatgaaaatggacaatagcacagccaagcatagactattccccctcaggtgatggagcacttcaggaaaaaggcagattcagtgatgtgagtatagaggtgattgagttgggaaagctggctcttagaaatatttcctgttctagaacctggactggagttgctgcaattaggcccatatgctttcagcgggtgtgtgaggcttcacggccttgggaggcagattcagagccaaggctcacaaaggtggctaccaccagaatccagtcacctgaggagctttccttccaaagcagagatgccctcatcccaccctagggccagcaaatcatgagctgggggaggggaagtctgggcacctctttttaacaagctcctccagtgaatctgacaatgggagtcactgaattaaagccattaggagaaaccacttagctcaagtcagagattaatctacaaatgtcgccttaacaattagcccattagaacatatgtatgaggcctgcaggcttagagaatcgtgctaggagtactagaaaaagtacagagaggaggatgaattaattctctcctgagcaggttttacacattcttctcagctcacagcagaacaaatgaccctaattaatgattctgcatgtttgatcagggtttatctgcctactgaaggcagagacccttctcagaaaatggacaattttctatatatgatcccaaaggcataggactttttaaattgaagtatataatttacatataataaaatccactatattaaaaaatacactttgggaggccaaggcaggaagattgcttgagctcaggagttcgagaccagcctgggcaacatagagagaccatatctctacaaaaaaaactttaaaaaaattatccaggcatgatagcatgtgcctataatcccagctactccagagggtgagtcaggaggatcgcttgagcctgggaggtggaagctgcagttgagctgtgatcaaaccactacactccaacgtgggtgacaaggcaagaccctgtctcacacacacaaaaaagaaaaaaatagatgtgagaactcccaaggcaaaacaatctggtgacattttgttttttgagagataatatcattccaacatctaaattataatgtttttgtcctggtgaatttattaataacaatgccaacaaacatttattgaacacctatgcacaagggccagagtgagagacagagaaatgcaaaactgaaacagttaagtctggcctggcctttgccctcagggagcatgggatctagaagtttaaattactcaagagtcccttctgaatgtaagaagcgctacacatatcaacagtcatctccaggatataaaggaaggatcagatcaggcagagaagcaacaccaccctcatttcagactcccaaagtggaacggggagagaaagtgagaaatggaaaaccaaggaaaaaggaagaagaatttttgacattccaagtccacctggctgttctaggaaaggacagacaccagtgatatggtttggctgtgtccccacccaaatcttatcttgaactgtcgctctcacaattcccacgtgttgtgggagggacctggtgggaggtaattgaatcatgggggcgggtctttcccatgctgttcctgtgatagtgaataagtctcacaagatcagatggttttataaaggggagtttccctgcacaagctctctctcttccctgccaacatgtaagatgtgacttgctcctccttgccttccgccatgattgttaggcctccccagccacgtggaactgtgagtccattaaacctctttttctttataaattacacagtattgggtatgtctttatcagcagtgtgaaaacggactaatataaccaggcacacaggatgagtgatgtggagaaggaagagcacaggacacagaagacctgggtgtgaatctccactctgcccctataagcaacatgctcttaagcacgtcacctaatctctctgggtctaagtttcccaatctgtgaaataatgagattgaaacagatgattatgagatgggaccttggtaggaactaaaaacttttggcttgaaaaggtagccctcacttatgctaactgtaaaccatgtatacataagtctgattcaacatgctgacaatatgcctgtccctaaatctgtatgcaggagacttgtttcataagatcacaagaataaactccatagacactcagattcatagtttgtgtttccagcagcacaatcaattgctcatgcagaatgtcatcccacaaaactaacacaagacatagaagggccatggatcagctttctcctgagtctgggtctcagctctgccatcactacagaaaattgagtggtggtctgacccatcgcctccctctccttgcctctgtgagctttgaaaagcccatgtttttgcaggctttagccttccagaagctcagactgagtctcagtgttttcctaagggaaaaagaaaatgatttttttctctttactgtttagcaagtatagttgatatgttcttgtcattcctaagtcatgaatggttctcaatagaagaagatataggccaggtgcggtggctcatgcctataatcccaacactttgggaggctgaggcgggtggattacttgagatcaggagctcaagaccagcctggccaatacggtgaaaccccatctctactaaaaatacagaaattagctgggtgtggtggcacacacctgtaatcccagctactcaggaggctgaggcaggagaattgcttgaacccaggaaacggaggtttcagcaagccgagataacgccactgcactgcagcctgggcaacagagcgagactctgtctcaaaaaaatatatatataatatataatcttgccaccaaaaaaggatttttgttatcatacatttaaaaatatctgtaatatttctgcagagccatttaatcatccataggtcccctaaattaccaagctagcactatgaaacatcacatttgacttatggaagcacatgcacaaaaatgctgtaaattgattcactggaaaccaagactccaaacaacggattaagtagagatgtattcaagatgaaagaaaggaagaagaaagaggggctttgtagttggtatttgggattatagcattaaaataaaatgcatgggattgccagataagagtaaaactgatttgttcacatgtaaggaaacctagtaaaaatctctatgattttacaggcattaggatctggtgcttccaaaagtgcaatactatgaagccatactctgtgtgcaatggactgaattcttaggacacacatgtaaatcggagagaatccctccttaaatcacctcaaatgtcctccataacttttggtatgaagaaaaaaaaaatccttgacagagtccacaaggccctgaaagctctggtcttttcctcctctctggctttatttcacatgcttccacatctagactccaggaatctaacttgcagttattctcattctccatttgcctcctcccaccccaaccaccacagagccttcgcacaagcactttcctcctcccagaagcctcacctgctcacatgggatgcccatccttcagaaatcagctctgctgtcacttccctgcccacaggtattctgttttgtgtagcagttagcaaagcagcaattttacatgtctttgtgcaatcattttgatcaattgctctcctctttcctttgctggatggcaagttctatgaaggccgggtgtgtgtccatttttagttatcacgaaattccaagaaagtagcaaagtgtctcaatcagtatttgttaaataaataaatatgtggagaaaaggctggagaattagtttgaagactgagtgtagtggaagcaaaagagaggtgggagaaacatggattaccctcactgagtgagaccctgaagtttataacccggaataaaggtgagatgcagttccaggtaatggcagcatccaggggatccctggtgaaagtggagcaggaagaagagcaccgcggtggtagaggtcgagggtctgagacacacacagggatagcaaggacagtcctgcacacagactcaaaggggatggggggagctgaggttgagaatagaagaggacagggccatccctgaatagggggaggggcctggacttagatgggtgacagcatcaggaaggacagagagaggaaggatttggtcggatggcaggagcctggagaaaacaggtttctacaagaacagaagggcaatgaagggccagagtgtccagcactcctgggttacaaagatggcccggcatggtggctcatgtctgtaatcccagtactttgggaggtggaggcaggtgggtcacctgaggtcaggagttcaagaccagcctgggcaacatggtgaaaacccatctctactaaaagtacaaaaattagttgggcgtggtgctgtgcacctctattcccagctactggggaggctgaggcatgaaaattgcttgaaccccagtggtggaggttgcagtgagctgagatcataccactgtactccagcctgggcaacagagcgagactccatctcaaaaaacaaacaaacaaacaaaaaacaaacaaaaacagaaacagcaacctccagagagaggagtgagggaaacaactatgtctctaggaaaaacagattcaactgaggtggcagatatagggagcattacgtgaagaagcagagaattcagatttgaatcaggactaggaatctgtgaaaacagatgtcataagaaagtgagatggagaggcataaaataatggaaatgccaacgttccaataataagtgaatatatttgtgtgtatttgtatgcacacaaacacgctgcaaggggcacagagacaaactgtgattcctctaatcagaaagaccgggtctctgtcagtatttattaaccacctgggggtctctatcagtatttattaaccacctgcatgccccccagcagtttgtctctgtccattttcaaatcaggtcacttcaaagtgactataaatacatacgaaaccctgggaaacaacagggttccctcttactataagtttactataaatcatgcatccatcagtatatagacaaagttaactgcaatcatggacttttttttgagagggcagaagaaaacttgactcatgcagatagacacagtgtctgaattctcattttttaatgctccccaaagaagaatctgggacatgattactacaagccaattgcccaatctcttcccttctgaggcctgtgacataactatagggccagagttatgtgaacttctgcaggttcgtgttccccaaacatcgcaggagtgttgtcctacatcctggattttgttgatgatgttcatctcattttgcccaaattaaaaatacagaaaagttcaatatattcctcctagggcttaatttattataactgaaatgagggaaagcagttgtaacaggaagtcagaaaactttccctaaaacctgtgtccttcctgcaagccgaggtttaatgacactgaaatcttacatcattgcatcataaaacttaaaaggttgctttttgcataattttaccaatgacattaaaaccgatgcactggcaagcatgataaaatcttccatttgaggtctaaagttggaagacctttcctgtccaagtattgaaaaacctaggggaaaaagttccatctgctggtggagcgctcaagtttgcagctaatgagctttttaagaaattgtctgacttaagtgcatgtgggtttggccaactggatttttaatttaattaggtttatgagatgagaaatcttctgtagcgtagtcaggtcagaagttgccactcactgtcaccaaggactaaatttgtggctatctttgccctacttctcaaaccctgccagttgttaaattacattaaaggcaaaactggaatttaaagctgggactcaaacaaatacttatatgcccatgtttgttgcagccaaaaggtagaagcaacccaaagtgtccatggacagatgaatggataaacaagatgagatctctccatacaatggaatactattcagtgttaataaagaaggaaattctggtccatactacgacgtgaatgacccttgaagacattatgctaagtgaaataagctatacataaaaggacaaatattgtgtgaatctacctaaaggaggtaactagagtagtcacattcattgagacaggaagtagaatgatggttccttggaagtgggagagagggagaagtggggaattattgtttaatgggtacagagtttctgttttgtaagatgaaaacagttctggatatggatggtgatatggtttggatgtcttccctcctccaaatatcctgttgaaacatgacccccagtgttggaggtgaggcctgatgggaggcgttttggtcatgggggtggatccctcatgaatggcttggtgtccttccagtggtaatgagttagtgagagatatgattgtttaaaagagtctgggacctctgcacttctttcttgtccccttgctcctgctccctctcttgccatgtgatacaccagctctccctttgccttccgccatgattgtaagcttcctgaagtccttaccagaagccaagcagaagtgggtgccatgcttgtacagcctgcagaaccatgaaccaagataaatctcttttctttataaattacccatcttcaggtattcctttatggcaatgcaaataactagtacagatagtgatgatgattgcacaatgtgaatgtactaaaagccactgaattgtacccttacaaatggctgaaatggtaaatcttatgcatattttactgcaatttacaaaatggaaggaaaattctgagaacccacaagtagaattcagaagcatatgtatatttaaaaactcaaacatcataaccctcccacaggaatactgacatctctcaattcaatggcagtgggtatctccaagaaacttgtattacatgcaagtgactcttccctctctagagcattgatcttaccccctaggatgctggaatttctcctttcatttccagaatctatccccatgtagccacagagatgttatgtgtgtcccgcctttcccttgcactgcactctagtctacaaccaatgcccaaagttggctatgatttttttagagaccttattttgtctttcggtaactgtagctaaagtccaagatataattaggaactttaaaagagtgttcccttcatcctataaccactttacaaacactcaacaatttcctctggaagataatgaaacacacagagggcatctggtccctaagactaaacctcaaggtcaagcttggttgtagctcctcagtggcttaatggaacattgaaagcacccctagaaataacataaaattttcatcttctacagcaaggattttggcaccaaggtcttactttgtaaaaggcttatgtaaaaggcttatcagtgcatcccagaaagcaatgccatctaagccctatagtgtcaagggagttggccaaaattgctaaatgaccattcagctgacgatatgacaccaacatcggctgtgcaggtgcatgctcacattcctggcaccaaacatgtcacactccattttctcctctgcagaatcgaatctgaccataacaatggactgggcttgctaagaatgatactagcatgcctctttgttaagactttcagtgggttgaaatccaggtctccaaagagaaagccctaacctgtctacttctgacatctctccttcctgccctcacctcagaaataaatggtatttttgtatttacaattgaattcttacagacaaactacccttcccgaatgaagtagaaagtttcacaagatagcatccctcatgctcaataaattcccactcctacagcctggaaagttggaaggcagagtcagcagcataaacctctgcatgtgtattcgcgcaagtttcgaaagcctggcccacagcccctgattccaccttgcttcctacaatggtctcaccattctccctctcacccagtgaggactgggtgataataatgcctctgtgccccctctagcacaggggacctagagctctggctcactggagataaacagtcagaaaaccacatcctctacatgtgtggggcatttgtttgagggtgggtggatgagaatgtggtcaggtaacccaagctttccttcctccttcagcctcacacttttgcaaacaaaagagaagaaatggagtctgtctgtagaatgtcacttgttatcttctcaaggtcatttttaaaaaggaagatcatgtgtatgatgttcgagtatgcttcatagttcagcagaccaggcacaccaggtacacagtgaaagaattggcaagacaagggccagaaaatgcgtggagatctttcattgcacagttttaagagctttgacatagttatcaggaagaaatcagaattgaggtgggctcccttaagcttactgcatggtttttccatgtgtcaaatttatatgtgaggagaaccttcatcctttcagggtttacggtctcttgctgtcataacccgcctgcatatttcagcacagccccagcctgatcaccaatttccatccctcatccactccatcagaagatctttatgtgctagaataaatttctcttaacctcccacaccagcctacaagtcattcattcattcattcagtgcacaaagttgctgagtatccactacaggttcagagttgacctggcaggggacacaaaactgaagaatgccctttttttctggaactggaactggaattttcattctcgggcaaagcaggatgccagaagccagatgatgttcatagcatcaaaagactcttttttttttttcctgagacagggtttcactctattgcccaggctagagtgcagtggcacaatctcatctcactgcaacttctgcctcccaggttcaagtgattctcctgtctcagcctcccaagtacctgggattacaggtgtgcaccaccacgcccagctaagttttgtattttaagtagagacggggtttcaccatgttggccaagctggtctcaaactcctgacctcaaatgatccaaccgccttggtctcccaaagtgctgggattacaggcgtgagccactgcaccctgccagaatgtgcatttctaataagtttcaggtgatgctgatgctgctggttcagagaccacattttgagaattactgcttttaaccttatttataaaagataaaaagtttattctttcaagatattctttttctttgaacatgggtataaaaacattttaaactgtttaggtatgtgccatttggacaaaatctctttaatatatctataaaaatatactttgaaggcttccaaaggggagaaaaccggctggagctctttatcttgaattattgttcaaaatcattttcagagtctagttcattgggctggacaatgccagcaaggtgtttggtttttaattaaagttgaaatatcatctccattgaaaggtacctcatgaatttaaccatgatgccatggctgctaaaaacaaaacaaaacaaaacaaaacaaaaatacataggcttaggctgggtgctgtggctcatgcctataatcccagcactttgggaggccgagatgggcagttcacttgagctcaggagttcaagaccagcctgggcaacatggtgaaatcccatttctataaaaaatacaaaaattagccaggtgcagtggtgggcacctgtaatccctgctattcaggaggctgaggcaagagaatcccttgagcctgggaggcggaggttgcagtgagctgagatagcaccactgcactccaacctgggcaatgagagtgaaaacctgccaaaaaaaaaaaaaatacctcgtaggcttagatttctgaaaacatgcttccacccagaaccataaaacttgtaaaggtgtggctgaggagactttgggttccaaagaaagcattcagaaagcaccacaaatgaaaaataggagttcatcaatatactgtttcctttatcattagaaagaaacagtgctaaaaaagaagaatgtccacatgacttccaaaaacaaaggaacccagggtcatgactctgtctgtttttcccagctatatctaagacttagaggggagagaacagctccctttgtccaggttccacccactgcaagaactttttggcaataatatgacttctcttgtgtgctctgtgccagccaaacttcgtaagaatgctggccagcttggcgcaccctctccagcattacctatgtttgttatttgaagttgccatgctagattttactttaaatgacatttcaagtacacagggtagttgaataggtttaagtcttgttgtttcttttcttttcttctattgaataatcaatccattcaggcacagaaagatcaactcttaggcttccctaattaccctgaatctgctacttcacccaagggacctcttgaaagaccccaaggatgctttaaacaaagcacttcttactctttattgtagtcatgagttttcttctgagtctcttgtctgtgatctcctccttgaggatggaaagggtatcaatcatggctgtggccccaccattcactcattcatttattcaatcaatgtatatttattaaatgactgctgtataccaagctttgtgctaagcctgaatatgcagcagaggaccaaagagccacagcccttgccctcatgaaccttacagtctgaagtagggacagacactcaacaaatgaccccactagtgagtaaaatttgcacatgaattaggaggactctccagagaaggggcaatgagctttgcaggctgtggagtctaggggtgttccatggaaggaggatgagaaggagtgaagaagatgaagactaacattgctctcacagaacccagtgcatctaaagctccttaatgcttcccccatggatgcttgttgagtgactggatggacctaggcagagttttgcactcaatgtgacagactggggaggagctctgtgtggagcaagcgatgaagtcccactgaattcaattgagggaggacccactgtcttcaaaaaggaagaggcatctccattctaaaggtggagcaactgaggcccagagagcttaaatgccctgtataagaggcagagcttagtctcaaatccaggtcggactccctgcctttgttcttttaatccatgactccaaagctccttcctgaattggtgggtataaatcctcctgtctctcagaaacttcttctccactttcccttgtgaaactctgtttcatctcatcagctttccagagttatttggtgaaagagcatccaaggcaggaagatttttcttggatcgctgtgatggctgcaccctccaaaaatgggttcacaaagggtaagcatcggccccactcattttcccaaaccatagcaaccctctctttctctccaagaaaattttaagttgcctgcatcactgtacatattattagcatattttccaatctcatatcagaaaagtcttctaatgagtcccaatctaatgtgacaatcatccaacaatagaatggctgctgcatgtggcactgagctttcagtccctggggacatttaagttgacacaggagatcacctgccaagaataccataaaaggaattccctgttatatcagaatgctgactgatttctgatggcattttaataagccaagaatagacgcttcttgacagtagaccctgccaagtgaatatgcctaaggagactctacttcccagtttgcttgatgtcctggaataattattaagagcacctcctttccactctcacaagtgccctgagtagatgccaaagaatatggtcatccaatttaagttgcacttgggtccttggagagaggcctaatacatcctgacacactggctgccaaacatccaggagaagatggggaagcacagttgagaatctgcagtgctcctgtagccactctaggagagtttctagttctctgtttagtaacctgatataccagcaggcgaacgacaatgtctaaaacctccatagttctgtgcctacacacaggcacacacacactaaaacacacacacacagacactcatgctgttcgcagagtataggagattctccgagagaagccagtagcatttccatgctgctagtggtctgctgatgagtaagtgttgtttttttaaggccttgtctggcattgaacatgattaataaattgctggagatgatggggactgctctactgtgattgagttactggaggcttacaaggatgaaaacagggatctctagatttcagatcaaaagcagtccataaaacacagcccctcaggtcatgggaagtggcatccgcaggcttctcaagatcgcttcccggtgaaaagagtaaaccagcctctgatcccatactgaactctaactcacatggggttcgaatgtgtcatatgctctctgtacctcaagtaataaagcagggagtagtgggagcccatcgcttatggctacttttctcaggaaaacttaagaccatgcaggatgggctggctcaattttgacagagagggtgtctctgcactgctaccttagtgcgcacagtgatttaatgaatacacgcctcagtagtgactgaacaaaagcagtctccaggagacgctgcaccaatgcaaagaaacacaatccaagcatcttgtggcagaagtcccagcagtccccagcctgggaccaaaggaggcctggccaagccttgatataagctgctttcccactgcacaagggcagagtccccaagtgaagaactgccccagttctggctcaaggagttggtggtcactccttgtcttcatttcaggggcttctagaagaccccctttccccgaaaagtattctctatctaagagcctgaaatttcaccattagagattacttcctttcaattttaccttaactctctttcttggacttcttaaaaagcacaaggaataaggagcaaatccatactgagttgttaatgatttcacagggtgatgttgaaatggcagcctactgaatatccacttgggctgtaggttacaagtgcatttccaaatattctgattccaaaggtctgatgaacagcttagaactctgcattttcaacaggcaccctgcacccccatctgctgtaattctgaagcactttgagaaagttcatttcaatgcaccatatcctctcagggaaagataacttcattcagagtttttaaaacctggattgtcaggttacaccccagagcaattacatcagcatctctgtggggaagaccaggtatcagtatttttctgatgtattagaaaaagaaagctccccaagtaattccagtgtgcagtcagggccgtggccacctgaacagccaatgggtgggatcttaatgctaacacagcagagcaaatggaacatgtgactatctccagggatctgggctgcctgggactcaggtctctgcactggcgaagtgggcagctacctggtcttcaatgtccccacttgagtgaccctggaggagtcttcagttgactcagttatggaggagccccatctcccctatacaaacccacacctctccttgaaaccacggtgatagggaggctgccccaagctgtacctctgaggagatacaggtaagtagaggctgggacagagccagacccagacaatgattggccatttgctgccacttggatttcagtagcctgagttgctttggcaggctgttccctggctctgtggggtccctcaagcaagcacagccctctcacctcctgcttttgggcacctctgggaccaggtgcaggatttggccctcaagcattgtgctgggtggatagctgcttcctgccagtggcaatgcaggcctcattccttgtcaaggaacaggcaagggcagaaggcagaagtcacatatggttgagagactctctaactccaactaaatccacaccatttttgagcaaaatgggggttgtgttcatgtatgagttcccaccaatctctatccatgtggcaattccatctgcaaaacccaagaaatagtggtgcatgttggtcccggggaactgggaactggagtgagctcagcaagagcccagaagtccgggagaactggtgcttaggatgatggctcaatgtccacccaaaacacagccgttatttcctctttgttcaagctctctttctttcctttctttcctttctttcttttcttttcttttctctctctctctctttcttttttttttttccagggtcttgctctgttgcccaggctagagtgcggtagtgcaatgtcagctcactgcaacctctgcctcctgggttccagcggttctcatgccacagccactcaagtagctgggactacaggtgcacaccaccacacctagctaattttttttttttttcagtagagttggggtttcactaagtgattggcctgcctcggcctcccaaagtgctgggattacaggcgttgaggcaccgtgcctggcccaagcgctctttttagaggcttgagggtaaacttcatcccagctccctctaatagaaatattcaaagattcaagccacatttgtaattttgaatgtcccagttagccacatttcaaaaaaaagaaacatataatattagtgtgtaaagtgtttcatatttaacccaatatatccagaatatttttacttcaacatgtcattaatattaaaaattcctaatgagatactagaaatacttcatgcacctgacacccccactgaaatataacagtgtttcatgtgttgcaacaattgttgcatcttgtgaaaattagtcctaccaaaacaacaaagtattgtttaacagacaaacattttatattccttcagtttttaggtttatatttttgttaattaaagttaaacacaaattaaaaactcagttcctcagttgcactggctacactgaagtgcccaatgggcacatgttgcaagtgggtaccatactgggcagactgagaatgtttccatcagggtggaaagtccttagatcccttaaataattagaaaaggtcccaactctcattctgctggtccaggctagagacacttagaagtgtcctgagtgacatgggtgctctctcgtctcacaaaaaagaagcacaagagttaagggctagaacagcataactagaacacctcccagagatgtggcctagagcaggtaactctcaaggctcagttcctgcctctgacagaggagccgaagatgagcatctaccacaaagaggtgtaaggattgagtaagttaatatgtttgtaaaacactcaaaacagtgcctggcacatagcaagctctctagaagtaagtgctaaataaatccccagttcaatggctgccagttggttgccagacactctgacatctttcatcccagaatggccttactggaagatgcaaaaaaaatctctcattgtgaacagctcccagccttctggctgccaaaattatacattgattcacctgagccttacctgatgcaaaacaccacaaccccacaccctgggggaaaaaaaaagctcagatactctgaaatgttctagaatgtctgtccctttcctatcctccaaaccatatcttcctgaccctccaaggtgaggacagaatgccatcccttctccaggttatttctccttattcaggtctgagtccaggccagctcctcctacaaggcctttcctgactatcctttctaaagcacgactgagttgtgagcaagcaagtacatgcagttaggtgcacacagcactggcctgtcccctcacactgtttcatttccttcattggcttatcattccctgaaatcacattgttgacttacttcttacttgtctattgcttgcctaacctcaaaagaaaataaattctgtaaggacacagacctggtctgttcagtccttgctgtatctctagcacccaggtgtgagtacctagaacacagtacatgctttatatacaattgttgaatgaatgaatgaataccctccttaaagtataggttcctatttccccttgcttgatattccaaagcactttccatctttcatattttgaaggcagtcaattccataatacttgatacatacagttaactatttttgtgtatatgtcttatctccccaactagacaataagcccctttgatggtatgtcttgaatgtacatccctcctgaggtcctcttgcatcctcaatgaatacttgttgatgaatgactgggaagaataaagcacaaatcttaaattaattttcttggtcacacatactagactatttctacaaataataatttttaaaatgaagtaaatatatatatatatacacatgcatctatatatgtgtattatgtttctcatcctaattaaatgaagctatttttgcaactgttttccagtccaagtgtaaaactgtaaagaataatgctaaatgttagatcattaagttggttttctttaattatatggcagtgtttcaaaaaggctttgagtcacctttaagattccttgccaggggtacagcacactacatttaaaatggcacttatcttagtaaacacatttctattgcaaatgatttgttccaataagcaatcccttggcaaagagctgctatttcttctagaccccctaccaaaacatggacctattataagcgccagagaagagaaagcttaaaaagcttcctttatcagaagttaccaagatacattccctaaagcagaagcatctattcatctacccttttctctgatttcaaaacctatagcacttactttttgtaaatatcttctataaggtagctgtaaataagtcctcaaaacctattgtgaagtaagctatagatgtaaatatacattcatcttttttctctctctcattttctttcctcctgcctctctcttattctccctttgtttctgtttttctaaaacaaaaatcagtaggttggtcacaggcaaatacaagttcaatttctaccagaaagctgagttcttgagtgattaagcatacaaaccaatcatttgaagggaaaaaaaatccagtaaaggctaaattattttctgaagtacttattacattacatgaagagcttattatgataagctattatacttgcaagatgaattgaattcacattcaggcaactcatctattcctagagaaacacagataaaaaattttatagcaacctgaaaaggtttgtggaatggatataaaagagatcaatactataagattttaatgtcaaattgaaacaatagaaaacatggtccaaaacaaggtctcaatttccaataaaaaggaaaagaagagataactggtgagcagaggagaggacagtccttcaggcaggagtggctggggaaggacctggtggaagtgtaattaagctgtaaaggaatcatggatagaatttggagggtggaaagcagtccacctgtaagttcatttattccacgtgtatttgttgatttcttactatatgctgggcaccattcccagcacaggggctatcacagagaacacatgacaaagaccccttattcagatgatattctagtggggaaggcaccacttctagaaattagttatgaaaaagcaggcacccttttatgtttacgtgtacatacatggaaaggaggcattcatgtttttgttttctactgcccttctcttgagcctggaaggttttcctttgtactgatggctagcattcctcttagctttgtggagatttgccttgcaaacaaagagttccctctcttccctcttgccactgtttaccatggggatgcagttaaggatcatgacaagccataaaagatttctcctaactctttcaagtatgactatcctgattatagcctccagatatggccagccagaatcacacactatttataggcttaacccacaggcagaattagtcatgtatcacacatgactaaaatgcaagactctcccagacctagggtcctaaacaaatcccctctccttccctaaaccttccaaagaagggcagtgaggatgcccccacaatgttcttcctacagacatgtttatttaagatctcctccccatcccctaatcaaggaaactacacaactgagctaatcatttaaatgatgctactgagaaacgaagccattttccttgttaaaaatgtgcttgccaccctatccatttatctatttccttggcagtgctcactgttaatttattgcccaataaagcacagacactagcagagctgctgaaccatgcctagtggaagccccactatttcatcccagcaaaggcaactgacaagcccaaagcacaaacacaaacacattggatgccacaaagccgggctggctaaccccgactccatttgtcatcccagagacacagaagggagggcggtttacagccttctggagaatgtaggtgattaataactatcgattgtcagaggaaatggagtaagtttggtcggttagccaactgccatgggttttctttctattggatggtaaacctcactgccgcagaagccatctcatggtgagttttgtggggagagaaactgagaagggaagtgatgaagaccgagatggggcagccttggctggccatggtgtccaccattcgggcagattgcctcctgttgcctcctgcagctaacacacagccatcactcataaagtcccaggcagatgtgtgcttttagtgcaaaaccttggcaatcattatcttgagtgtggaggggcttttcttttcagagtctccttcatgggcaactggatcaaccacacagaaggcagatccttcttatttggacagcttagacctcagagagcctataccaactgaatatttgtgaggtaggatctgaaagcacaaccctgagcttcaggatactctttctgatgtcttgactagctccagtttgcctggaggtttaaaggaaaatgtacccagaaaacctgggctcttactccagtatctgtctaatacaggaggaggaagccttctcaaagccaaaagaacagaacaccaagaggggttccaaagattgggttcaaaaaagtcattgaatgttactttgagaaggaagcaaggtcacctagtcgtaagcctgtattttagaggagaaaactgggacccagagaggaattgacttgtccaacgccctattgtgtgttatggacagaagcaaaattaggaggatgggtgaaaaagaaggaagttccaaaagcccacagggtctgccttccattgccatagtcccaattgttgctcccctagtgagggcacagctggcctaaccactcacaggcaaaagacataagactacaacagaccccacaaaacacatgcacatcatccactcctgcaggaagttgtgagcaggttgccctgctccaccatcactgctcagcaggaggtagagaggtagatgagaggagcacaggacctgagaaccaggagaaaaggatggcaagggaggcccagccccagccaaggcccagcccagttatgtaatccaccctgggaggttatgcccgctgctttccatccacggattttgcaggatgggtcttcactaggaagatgggggaaatgtcccagagggaatcctcaccagccctgtcccatgtcaagttctttatgcctctgaaccttcctcaaacggtgtccccccttccttgcccttgccccacctctccacattcacagggcatcttaattccctaagctgagtcaacatgagtaccacagtcctctccgcttaaccaggctgctgcatctcagagtgagcctcacagacacgcacagaatcagcacctgctgggcattttcatgtaatttgatgatcacctctgtaataagactcctcaggagctgagaccatccttcgtctaccttctagcattgtgtctccattgggccattgaggccatctgctctggaagttcctgcaggggcctgctaacaggtagatgcctaggcctaatccctgacttgcaaactcagaatcttgagccagttcaggaataactgcctagagtgcctcccacagcaaagggcatactgcagacatcaggaaacactcattgatcacagagaggggcttggcgtcaggggacctaattttaaccttgctgtgtggccctgcggaagtcacttaaccctctggtattcaacttcttcacctctaaaataaatgtcagacatttgtggatcatggatgtgaagttaccaacacagatccaggctcagcaggtactcaattcgagatgtctgtattatgcgtgaggtttgttcatacacagattgacccagtaactaccctgaaccagatccccagggagtgggtttctaaaggctggggactgggcctggcttgagaatatactaatcacacaatatatttataatagccaaacacactacataacctatcatattataaatgaataatactataaaatattaatagcaaacaaaatatggtacatattttgtgccaggcactattctaaatattttacttatatttccccatttaatccccacaaaaaatttagaagatagttctattattattatccccactttatagctgaggaaactgaggcccagggctgttaggtaattctcccaatgtcctgtagccagtaaatgacacacagcggggattcttcaaactcccacaccttcctgagatgtcagctggctgtgtggttcatgccttctcttcattgtctctgccctgagatgtgctcagcaagtggtcgttgccttaagagagctttgccttcccagcatggttgggggaagctctccctccttcaagggaggagaagaaggggtgaggagccactaacagggctcacctgcaaagttttcaggaccatacctccaggccaaactctaatgagaaggagcattcctgggcctcagctccctggggttcagacttggccccttaccataaagaggtcaactaatgcaaaatgcagaggctgcaccatgatagcttttccacgatgggtctgggccaggattgagggcactgtccagcaagctgatgcatttttaaaacttccgaatcattgatactacctccccagggaaaggaagacctcagcagtttctccaacacccagtccacatgccaacctgccagagaagctgggacggaccacagcaaaagcaccagcacccaagctctgccacagacaactgactttcagggacatgaatgacctcctcactgaaaatgaccttccccagggggcttattctctgaacttctggaatcaccaatcacttctccatgtaactgactctacatcaaagtcgatgcaacagatcacatttctcaccactcccactgccccaacctggatgcaaagtgtcatggtctttcaccagattattacaataacctcctaagtggtctccctgcttctacacttgaccccaagtaccacaattggagaaggatgatctccaaagctgcctgggaagtctgcagttacgcctttggacatggactgttgggacttttcagtttctaagagttcaaagaaaaaagaatgctagagatgttttctttccatccaaacaactaaaggcttgtatctttccattaatcaataccaagagctgttcatgcagctcaaatccaaaaatgagcatgctgagtttctcaagtctgtcctctgatgatatgtatataatcagcatgctctgttgtagacctttgtgacaatctgtgtcacttagtacaagtttacccaatgtcatttgcatttaagcaaatggaaaagaattttctcagaccctactatgactctggccacctgataggtgctatagaggacaaaacagaaatataaaatatgattctctcctttaaggaatgtattttttctgatggagagacaaaataaatgcccaacagatagacaaacaaccatatcagaccatttaaccatttccatatggttaaatggaaatatcagtaggaaagatattaaacaccttgggaattcagaagcagatgatcagtttggctagaatggctgggaagataatctatcaaaagtaagaaaagtgataaatgtgtgaagtgtaaatgagttgtagtattgcatcccaacaggcaacaaatatttcgtgcactggattgaactgctgctaatactactttcctctctcctgcatttggaaaaaaacaaggtggtctccgaaatccagcctcaacccaggactatggaaatttgtaatggcagtgaagacaaaaaatattttctctgccatatgcggtcaccaaaagcaaagcaaaaattaaagcaaagtatataggatttggtatggtaaaagtgaagaatcacatgacgattcgttaaagaatataacctccacccaaggggacagttgagggatagcaaagtcattaaagcgtcacagctaaaaggaaaaataagtctttcagctactattatccatccctctgctattcagtttcatgaagtgaagctactggagtagacactgtattacatcacaaatttgttacagacattcctgtaaaagtggctttttcctcatagactgaaaatacacctgaagatcccctcatgatgaataggaatagtccattttagatgagtagattttggaagtgtttccacacttttttttgtttttaggtttttggggggtgtgttgttgttggaagctccagcattttcctcttcaccacctgcagcactgggacagcaaagctgaagaatctcattaagcttcgacaagaccaattttttatttttagccagtcttttaagacaatgtgaactctactacatttagaataattattccatcaactatttacttaaacattttagaggaaaggaaagaaactgggagatgtttaaggctttttataacagattgtttcaagggtaaatagaaaaatccaaatgcagctgctgaaaacacgtaagcccatggcagggtgcccacttgctgcagcggaagtgaatggtgagaagagatgaaagatgtggaagacaaatgtacccagggcatccaatcccagcaagcggacaaagggcagattcataacactactttgtggttaactggtaactttcatcagggaacctcaacacactttacaaataacacttattttcctgtctcacagaagcagggagataaatgccaagcccaaacgtcacacagcaagggtgtgatgattttaagaataaaatccagaccttatttcccagttggtggcctaccaggtgtcttgatatggtttggctatatccccacccagatctcatcttgaattgcagctcccacaattcccacatgtcatgggaggaacccaatgggaggtaattaaatcatggggcaggtctttcccatgctgttctcatgataaggaataagtctcatgagatctgatggttttataaggaggggtttccctgcacaagttctttcttgcctgctgccatataagacttgccttttgctttctgtcatgattgtgaggcctccccagccacatggaactgtgagtctgttaaacctctttttctttataaatttcccagtctcagttatatctttatcagcagcaagaaaacagactaacacatgcctcccttcgaacccacagtacatccccaccatttgctctttccataaaccagtttcctttgaaaacttccagatccttcctcctctaatagagaacaccaacataccaaagactacttcagacatgaaagaaatggtgtgcttatcttgaaatctcaagtggaatggtaaaaacttacctaggttcatcaatgcgctagaaacaccacaaattaccaatgcaggggaaaatgaagtatgctgctacaagggatgcattgacagactccagagaacgccactcttggtaagctgattctgaccatatagaagttattttataattctgtaaattgtacataagtgacagcaatgcaaataattcctgtccatggacatgaaaattctgtcctgtccaagagaagttccattgacttctctcctgcctttgtggaaaaaaacagttttgcctctgtttccacattcatttaaatattactgacctgtaagtgtctgttcttttcttttttgtttatgtttgtgtctttgtttcttcaagacagggtcttgctttgttgccctttgttgcccagactggagtgcagtggcacaatcatggctcactgcagcctctacctcctaggctcaagggctcctcccacctcagcctcctgagtagctgggactacagacaggcatcaccatgcctggcttttttttttttttttcaggtataggcagagtcttactatgttgcccaggctggtctcgaattcctgggctcaagtgatcctttcaccttggcatcccaaagtgctgggattacaggtgtgagccaccatgtcctgcctgtcctcaactggttataacatctgcctggtcccctcattgaataggagtagaataaaatctttaacacatattcattttgatatctgaaagtcatgattttcttcttttgtgaaaattaatttttaataccaattcaatctcagaaatgctcaacctcaaagttagaaacacagatgggaacagcaagagatgttagaactcacaagaggactgatggagaaaataggggtgtagatctccgaacacaaattggaaaagattttcttatgagaacaaatccataaatcagaaaatatctgtgattttatcctctatcttcctaccacttcaatcttgttaactcaaatataagacatgttaactggatccaggacctgagccctggcaagtgccacagacaacagcatgctatccaaaggactgcccttaggaagcccttaggaagccttgaatgcattagaaaaaaagtactctcccctctggctgacacagcaccattctggagcctctggcttagcaaaaggggtacaggttgcatttgagtgctttcttgtaccttcttcagctgggcacctttgtgcagtactcaacctatacaactgtacatggtggccatgaatggaaggaccactcatgacccaggacccaaaaccataacagggatatatagctagagaacagctgctgctaagcagggcatgagagaaactgagagggctgtgtccgggctgactttatctagaccactgagatccaatacgattgaggaaaatcactaactctatggcaccctgctccagccatgcctgggaaccggtgactgccttatgatgggatgcccttttcagggagtcaagaagtgcctgactggtaataaaaaggaatgaactactgatacctgctacaacatggaggaaccttacaatcattatgctgcatacaaaaaagccagacataaaggattacatactgtatgagttaatttgtattaaatgctcagaatagaaaaatctatagaaacctaaaaataggttcacacaaagtagattagtggtttcctacagctgcggtggttggggagcggactgaagggatttccccagacactccaatccatgtgtctgggtgttacgataaccatgataataaaagccagggagacctcagtttgggttaacagggaggttaacctcattttcatgctttgtttttcaacccttattactgactggttctgccacgatccttaaaacatgctcttagcaaattttatttttagtaactatcacttagtctttctccccagctttttcccactttcctcccatcccttagatcccatctctcacatctgtatgttttacccaacaggatggaaagagaacaatgtgtgggggcagatttggtacctgtcatggccttgacctctggcatcaggcttcctctccctaaacaccccagccaggctgcactttcctccatgactcaggtgaaccttcctctgtgccaccacgtggactttgcaaattctgtttctcctatctgcaacattctctcccattctcctcccaccagtcttctttcatcatggatgaaggatgactcttattcttcctcctaatctcaagccaagcattcttctcggaagcctttgttgatctttaatcccttggctctcatagcagaatgtgtgcagggcaggtatattagaatttctgtaggttaaactcataaactgtgggactttgttgactaggtgacatcaagggaaacagaggcaggcttcttctgtggaataattgtgcatccttcctgcccttctaggggtcctgactatctccccagcccccagcctcccaggctccaatctgcaacaacaaagagatagaagctctgataagaaacacaggtggctgggcgggtggtgtgctctgtagtcccagctactcacaaggatccccttgagcccaggagttcaaattcagccggggcaacatagcaagaccccatctctaaaacaaacaatcaaaacagaatttctttgctaattacttttgacataaaaaaacaaaagaaagaaacacaagtgattgtagcaccaggacccctgaagctagctgaatatgttcctgcctctggcagagtaaatgttctctacttttgagtcagaccagtgaaggccaaccttcgtcttaggaagaagttgtggtgccaacataagctttggagccaaacagacttagttcaactaccagcctttacctagtttttggtgctcccattgactagtctgcggcaacagatgagttaaaggagatgttgggtgtgtatcctaacacactgcacaggctgtgttgcagaatagtcagtaaatgtccattttctttcttcacatacaccttcttctttctgcaccaataatttaagtaagaactttctattttctcctctaccaatctcagaactgtctagatagaagttaaaaccacctcactctggctcgaggaggagggagaaggaggcagggtttcatttcaagatcagtcagcccattgcagctggctgtcctgcagcttcaggagaaacaccagtggtcccacagctaaccaagatggtgcctgtcaggcacaacagcttgatagggacagccgcattccctgtcagattcttgataaagtacagcacatgccaggaattctgtgggcccttcaggcacttgtgctgttgacacccctatggctcaaaatcagaagctgtctctgaatttgatgaggtggtagagttggatcctttggcattgagggaagaatggcagaacgtgggtgtttacaaacacttctgtccacttatgtatactgcagatacttaatggagtgctcatcctgtgctgggatagaactgagacaaaaaacagatagtagctgctttcagggaacttaacaatgtcagttaatgggggagacaggtatccattcataatcatccccaatgaatgtgaacccaaaatgaaataagggcatggaagaacataacacaattctagaagagctgctcacaaaagatcaaggtgaaaagaagtttctcaagaaagtcgcactggagctggcatctgaagaatgagtaggtgctatttgggtgaaaggcgtgtgctgtgggaaagggatgggaagaagaggagaaagagagaacagcatgtgcaaacagagggaacagcacatgcaaagcccagtggcaagaaagactatggcgtggtgaaaaattgggctaaagacaatatgaccagggctggacactgagggtgagagtgaaatgcagcattggggaagagaaagtcaattcctaattgttcaggaaaggtgactgggtgataggcatgaccagaagaagagaggtttcctatgaaactctgtactggaaatagagctgccacaataggcaacaagaactaaggtacctagaacaaaatgctctgtcattttgttccctgggagagtagagtaaaattcaattgaacagaggttgagacagcctattgataatttaaagaaaaaaaatttaatgggctaggtcatcatacaggcatattaaaatgtaaaacagcagaaccaaatcaaatttctctttgacaggcttgccctggttttataatccctctttcaggggagactctgttgttgttattattattattattattgctcaagatggtgtctctctatgttgcccaggctggagtgcagtggcacgatctcgactcactgcaacctccacctcccaggttcaagcgattctcttgcctcaacctcccaagtagccgggattacaggcacatggcatcacacccagctaatttttgtatttttagtagagatggggtttcaccacattggccaggctggtcgtgaactcctgacctcaggtgatcctcccaccttggcctcccaaagtgctaggattacaggtgtgaaccaccgcgcccaacgagactctgttaagctgaaaatattgagctaaatgccagtgtcattcttctgtaaatatatgtaattgccatttaaagaactctcaaattaaggttataacagctagtgataaacattccttcatttctcacaatattataatagagaagaggaccagcattaacaaactggcttttcctgttctcccgaaacagtcttaagtgatctcatttatcatgaatttctgtaagcattaacagtttgtaaaatgagttaattatgttctttggaggtttaataaaatctaccaagttaagtaatatcccgatgctcttgaaatttacccagaaaactttaaagaaagaaataaatgcattcgactgagcagaacatcatgtatatttttagaaagcatacattatctcacaatacttatgctaaatatgtaagaaaatttctgatagactctaaatcaagtctagttgtaaaaggatctctcctctaaagttttttttttaatcttcgtatcaatgtataaatattggcatctatgcaagccaaatatattccaaatccaaaagctttggcaatccaaactttgagagaaagaataataaaatctaacctttaatgagaaaaagtaggaatttcaagaacatgcatctattttctacaggcagtggtatgagagaaatagaacagacactgaaacaggtgaaaattaagatgttacatagggatggcatatgggactcattaagtttaggatggtgttttgcccttctttaaaatgtgtttttcttttcccccaccataaactcaatttgccccaggtagtaaactgaaatgactggaattttctctgattagatttctctggggctgttactgggtgttaccacatggcataggggtgaggtgccaggctctggagtcaaattgcctgtgctcaaatgctgcctctgccccttactggccatgtatttttggaaaagccagttactatctctaagttccagcttcctcatctttaaaggaagaggtttgttattatgcatacctcatgggttgttcagatgattagatgagatgtgtgaaaagtacttacttagcacagtgcctctgtaaaggacagcgatcagtattcccctggtggaaacagtggccatgtttacaagatgaaggaggaaccagtccttactgcctccctgtgtaatcaaagtagtcattatctcctattgccagggtttccttatctctatcactcatgtcctgtcctgacaacatatttataatgggactctacctacacaattaattgtgtaattttttttctttaaatctcattctttaaagttcaatttttaaattgaactttatttcactaccacaaatggaaagcccatctcacttgctataactagaaggtaattctaaacatacagcaaaaaagaaaacccagatcatttaaacgccacctcgatcttgtcaccccaacaaagactcagagcctgagagcggaggctgattgccaaagtttagagaggtgttaaagacctggtagaacctagggaagacattctctctgtgttaaagagaatgtaaaagaaaacataaccctctcctcattggagtctgtgtcatcctatgctgggtcaggccaccacctaaaattacgccatatgcccctggtaatacccatctctcacgttgttatctagagtgatttccattgtagtttatggagttttatgcataaacagacagtgttctgtgatacctaagaatacttccaaaattcccatggaaggaggctcccaattaattccagtccattcatttttaaaattgctgagtgaggcattagaattcatagaatttgcagacctgtgaattcccctagccagcagcaatcttattagcatatccgtaagtctttgcaaatttgactagggacggtgtgtgtgtgtgtgcggggggggggggggggttccattcttactttatgcatcctcatttatacaccctcctctctcttgaggttgagtttctaagctgatagatcataccttccatctctgtccataaatgcctttgacccaaatatcatgcaagtccaatggtacacatgtcctctaaaacaccctaagtggaaagcattgcctgttgaggattagagtagacatataatcacgtttcatactgagctatggccttcatccaatacaaatgccacattcacttaggaagggtgtgtatacatgggaaacagcaggggaatcaaggacaacttcctgaatcagcctgctcagcaaatccaaactcattcagccacaaacccagttcattcatgcatcagggtttgcactgctctaataagatgaatggaaatgcaaagacaacacttggagggagtcctctccgtgcactgagacccttgtctgaaaatacaagcaactgctgctgcttcacactcaaagagccaaacattttgcatggataattcagaagcagtacgtcactgccccatacacaatcctcatgttaagggagcctgcatcaggaaagcacagactatctacctacacaaagaggtcattgcaaattcctcctctccttcctgttgcattcactttagcaattttattacagaagagactgtctagtccagaagcttgctcagtgatgaaagaagccaatttgggatcctaaatttgactatagagcattcatatggacaactgggaattacctggtttgtgaactaagcaaaagccaaaactctaaacaccttctgagcatctatgaaaaagtatttccaaatcacaagcattcattttttagatgggagttggcatgaggatctcctgcaaagagagagagagaggtttcctggcatgggatggggagtgctgagcaccaagacacatgtgcaagctgaaagcacaccaagtgctcttctctgcatccagcacctcacacacattaactcaaagggctgacaagtccctggatcactcagcaggcaggcagcaaactctcagagcaaacagagttactgctgccttatcttgagctccactattaacacacttgtcatcactaagccaggttgttagtctctggaacaatttgatggaaagggcaaacaccagagaaaaacaagttgacccagatgggctggcagaggggatcaagtggcaataaactccgttatcactcctggttggcaaacaaaaagctctgcctacgcatgcattccagttaactatggacttcccctcatacatgcatggaaggccattatgcagagaaatgggcacagcaaatcacactaaacactgaaactctgctgaagtgactccagtgacttggagttgttgatctaaaaattgcttattcttgccttgacaataaaatcagagtccaagttaataaagatttctagttagcaaagtccccaagagcaaacagtttattcagatcaccagctttctgctttgcagtgtgaagagattaagggtccagggacactcctagttctggttctgcctgtgtacatcactgagcctttgtagacctcagctttattccctgtgagacttagactgatcagcagttctcaatctgaatgtgatgacagagtagcagaggtggccgaatatagaatcctcaaaattaacttacaaccaaaggctggtatctgtcagtagctttacatgtattgactaatttaatcttcacaataaacctgtgaaggaggtactattatcatccctattttaccagtggggtaaccaaggctcagaaaggctgacaacatgcaagggtcacccagccagccaggtgcagaggtgagactaggaatcatgtggtctgtctccagaaatgctgcttttaactactcaactcttcataatctagtgcctctcaataatggttaataatagctatcagtatggccaattgatggcctgattagaggagatctgaggcttgaaataaaaggctactgatactcgcattttaacaagctttttttgagagacaaagaagtggagtttcataacataacctggagtttgcatctcaaaagtgaacaccatccacaaggccaggcaagaagaaaggttggcactggctgaccacacaatgtggttggttccacctcacttagccatggagtctatgattccttggtgctatgagaaagaatgctgcaatctgctcactctcattttgggaggaccaaagccctgcctagcagcaatgacaatcctggccctaacacagctgggagcctcttgacaggcttatctcctccagctccccaggaagtctcccattggctgtcagatcaagatcaccaaacccattctcctaattagctccttggcaggcaaaccacacaggagcagttccctttccaccttgaacccagcagacagtcccactccccagcatcagccagccccaaaggcacagggctcccctaaggcctgcatgccctaagtgtctgagaggaccccatgactacagcacatgtcactaagtccctaacattccaatcatcagcaggcatctgtaactccagccggcgtccctccaggtatgcaaatgccatctgcccttacatgagggaaatggacagcagcggaagttaccaagggcccacaaggtgtcagcatctgggacagaaatgaagttccctccctatcaccaacttctcttttaaagaaccactcaaaccctgccaagcttgtacaagaggagtaaataacaaaatgacacagatgacccataaaggatgtatatttgcttaaatgaaataatagagtacttcacaagtgcctggtccatgtaagacttttgttttgttttgttttaatggctatttcaatataacactaatttaatagatatagtttaaatataagggactgtaaatagagtcttcaaaatagtacatcaaaaatttccttcatgatgaaatagatggcctactatgcttatccagagttattcttgcaaatttctacctgtagatattgttcggcaaataggcaagttcaattgattgttgattttaaataaaagttctaactgagaaaaaaaaagtaagcccataagagaaaccagtttcaaaaggccacatcctgtggattctccttatttgacattcttgaaaagataaagctatggtgatgaaaaacagatccctggctgccaggggttagagatggaaggaggcggttcgatgcggtaaaggcacagttccactgattatagtggtggttacacgcctccatacatttgtgaaaattcatagacctacacaccaaatttttttaaaaagtcaattttattttatgattacctaaaaaataaaaatgtttacaaggcccatgaattgggttgtctctaaaagatgacttttcttcatatttcttccaaattggttcatatttagagcactattgattatctaacaaaattttaaatggaaatagttgcagtggagattaaatgaaataacatattaaactgcttttgaaataaaaagggcatggaggatgtcatagaagtagcggtgcttgcagtaagaagtcagatcagactttacaaccttgttaaatgagggactgaaggcctggggtccccaccactccttcccgtgagccagtgcccttcgtactccactttccttatgtgtgaaaaggggcacctgaggaagggttgtatcttcaagcactttaatcccattacccaattattcacgtgcacagacccataattgggagttagatgttttccttcagtgctcaaaatagagcaagtttgtccctcaaaaccaaaagtactcaggtcatgaatgaaggctgaagaaattctgatctggcgggaaattccactttctgacaaccctgatggtacctctgaaaaaaacaaacacaatgactgcttttgaagggcaggagacagaaagacttaaccagtacttttcaaagggaggaaaattctgtgtcatcgtaagcttgaataaacccagtgctgtgaattgccaaaggagaggttaactgttttgaaagctgtggcatttttctcatcagtgtctcatgaggctggccaggaggggcagttggaaagaaggctcggagatttgatattcaggaagtccaccagacatgcagcattcttgacaagatgcctttcacctaatgtcatattagcaattcagacagaaacccaggaaagttagcacacacatatgccccacgctacacatgagccctcctcccaaaccacagcttcccgtgcctctcttccccatgaatttagtaccagcctccaagggtttctgccttcctttctgcaagtcaattgaagtaacttccagaaatgccttaattacaggccagtatcactgtcattagaggtttaaataaaaagtccccggattctaacctgctgagatttcttgtatgaaatgtacttacggaactttgataaagtaccagtcaactctaacacttaaatgggaaaaactgttgcagctcaaaattcaactctcatgcaaaactccagggatgaggcagcaaaggtaccacctcagcaagaagaaaaaggaagagagaaaaaagaaaaacaggtactccataaattacccacataaatcagtttaggcagactacaattttttttaacacagaaaacgcttaaaggaaaattcacagaaaatccatgattactcctttagcagggcgaaatgtcccaataagaaggagatgtattaatgggtggccaaccacctcttttgctccagtcgccttccgtggagaataatcaacagaaggaaatctaaaaatcaacatagagaggctgcggtgagctgcttcatgggtcctgggatagggggcatctgaactatttcccagcgtctgggggaaaaggagtgaacattttcaagtgcctcatatgtgctggtgctttacttgggctgtttatttcattttttcatgttctttcaaggtgttcttaattctgccttacagaccagtggaggctccagtatgttagataaattccccaggggcaccagttaaggatcactaggaatgcggaattcccctccagctcagctctgccctgaacatcttgatgccaggagtaaattcagggctctgagaagggtcccaaatgttacaaactttaaaattgaactaagggatgaaagtttaaaattgtcttcaaaggaattcctcaagtaacataaccctgcacatataaaagtgtcagcaggctcagattaaagggctcatgaaagagggttatttccagagataagaatccttcatcctcctctgggcagggcagcagagatagaaggcacagccggctgagaccccgccgggcctcaggaagtctccactgttaaacccagcctgcaaagcccttccctcttagggatccactccattagagttgacctgaaagctgactcctttggagtggtgcgttccattaattcatccatccaacaattgcttgctgaggacctagtatgtgtcaagacagctggagatagagcaaggcaccagtcatttcagtgttttcagatgaattccccacctattgcctgctctattcttaatcacaggggcggcccccactatgttttctggcactgttgccaactggatcatactggatttggccagtggaagcactgggcaaagcccagagggcggaaggaagggagaagttggaacctgtccctctcctgtctgttcttcagccatgattaggtctcctccatgataccacctcctctttttgtccttccaggccccagctcctttctcttgtcaacctccgggttgccctacagtgacctacttagccattccactcttctgatgctagggtaatagttccctacattaaatatactctcttgagccactttgttttcctggctgggttctgacctctacaagcattgaatctgactaaccagatccctgccctcttagaacttacattccagtgggcaggaatacaataagcaagtaagcattcaaatacatgaataagaacagttcctgatcatgttaggattatgaaggaaattagcatcgaggtggcaggatttggggatggagagctatatcagctggtaaggggatatctctgctgagatctgaagaacgcaatggatctacctttgaaaggccaggagaagagcatggcaggcagagggaacagtaggtcaaaggtctcccaggaagaactagcttggtgtgcttcaagagcctccagaagccaatgtggccaatgcatctgagcaatgggggatgtgtcaggggccaatgccatgggaaggagtttggaacttacaattgatttcatttacatttaaaaagatcactttggccaatgtatagggaattttcctcattgtttataaagagagacccttaatgcctcaccctgtccaggcatatccccatcttgaaggtctaagagagagctacccctcctaatgagtttgcacaacaagaatgggggggacaaccatagctcctaaagcatggttctgagggagaaacggtggttcccttgatatcagctctaccatgttctgaggccatggtacagaagaggtaaccattcatgtgcatgacagccctgactctaaggggcattgtgggttcctttcttaaccattctggaaggttcctggtgaaaggactgatgcacatccacatagccttgcattccaaggtgatccactggaccgtctagacttttatctctggaccctgggagttgcagacactgtatcagaacctccaaccttccccttggcctgccagaaagctgaaagtttccatgcctctgctttccagctctttctctgctacatcagagagcccctttctcatgtcctcaaagtgacaaatgtatgctgccaagcaaggctgagggaaagaaggaaatagaaatgcagtccccatcatgcattctttcccaaaatgcgactaatctggcatttaggttgtttgctcctttaatcagaatgccattaagaaatctctgccgggtttctgtacacagtttttctctaatgaagcatcaaatctctttcacaaacaatagctgtgtcacatccaagcaccctggccccagccggtgtggctgcagtctctgctaaatgtgctgcctctttcaggtctgttcctcccagaatagcccgccactgcggtactcaaatcaaagtctcgacactgtctagctccagcaacgtggacagacaaaagaaatcagaggttttcaagaagacatagtgctgtgtccctagaatttgacagaatagcttggaatatgatgtttaatgaatagcctttctagtgaacatgtttgtcctggcttcaactctgggcccaggtttgcagtggctcacccaatgggtgtacttatcatccttgacttaacccccaactagtgagctatttcctggagggtggaccttgtcagaggcagaactataatgagatgtccccagagctattagtgaataacatggcagagccctgctgagcatggtgtttgaccaggcccaggtgccatggtctctaagcatatgttcatatatacatcttggaaggcaatgcagcaacaactatcattatttaaggtgcacataacctgggacccaaaaatgccattcataggagtttaccccatagatacactggcacatgtgtgcaaagaccaatgtaagaatgcatttgctgttacattgtttattacagcacaagattagaaacaatgttacaatcagggccaggcacagtgactcacgcctgtaatcccagcactttggaaggctgaggtgggcgggtcatctgaggtcaggagttcgaggccaggcttgccaacatggtgaaaccttgtctctactaaaaatacaaaaactagccaggcctggtgccacacgcctgtaatcccctctacttgggaggctgaagcaggagaatctcttgaacccaggaggtggaggttgcagtcagccgagattgtgccactgcactccagcctggacaacagagcaagactctgtctcaaaaaaaagaaaagaaacaatctattgataaggggctcccaattacatatatttggatacaccaatgcaaagtaaaaatatgttgtagctgtttttaaaggcaggtatataggtctgatgtgaatagatcattaagaaatagtgtgaggccgggtgtggtggctcaggactgtaatcccagcactttgggaagccaaggtgggcagatcacctgaggacaggagttcaagaccagcctggccaacatggtgaaaccctgtctctactaaaaatacaaaaattagccagcaaggtggtgcatgcctataatcccagctactccagaggctgaagcaggagaatcacttgaatcccggaggcagaggttgcagtgagccgagatcatgccactgcactctagcctggacaacaagagtgaaactcggtctcaaaaaaaaaaaagagagtagtgtgaaagtgcaccatcattttttaaatgggaaaattatacatagacacgcatatatgtgtgcacatacgcttgtatgtgcatagattctcactgaaagtgtacactagagattgttaataaacagttttcaggccgggcgcggtggctcacgcctgtaatcccagcactttgggaggccgaggcgggtggatcatgaggtcaggagatcgagaccattctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccacagtccggcctgggcgacagagcgagactccgtctcaaaaaaaaaaaaaaaaaaaaaaaaaaaaaacagttttcagctctgggaaggaaaaatggggcattagaaactggggatgaagagatattttaaagtatatgatttcaaacaaattaacttttttttatttttacaagtacatacttaatctctttaaaagtaattttgtaaaagggcaaaatgcagtgctccctgaggctctggtaaataaaccgagaaatcactgactggaagttgtggtagataaaataatgaccctcaaagatgccagtatcttaatcccaagaacccatgaatatgtgaccttacatggcaaaaggggtttgctggtgtgattaagttaaggatcttgaaatggggagattgtccttgattatccaggtgggcccactgtaatcactaggtctttataaaagggaggtagagggtcagaatcagagaagaagatgtgccaacagaagcaaaagtaagaagtgatgtgaggaaggggccatggaccaaaaagtgtaggcagtctctagaggctagaaaaggaaaggaagcagagtcttcccagagccagcctccagtcctgctgacactttgactttagcccagtgagatgatttgggattctgaccccccaaatctgtaagacaataaatttatattgttgcagccactaagtttgtggtaatttgttacagcagcaacagggaactaatatggaggtaaaccttttaaaaccaactaattcatgtgtcagaagggggaccatcagccatgcttacccaagtggaggctcatcacccttgattgatcattctgctggggacaggacagattttccataacactatcagttccaatgaaagctgatgtatgaaaaacatctcccttagttggtctgatggtagcagtctcctggatagaactgccatcccagacccacactggggtgagcttggcagccatctggcctcatcactatgctcttcacagaatgctatctccactctagcatgtgtctgtctcatttatcaagctgatgacatggcggtatgaaaaaaacagatgagaggtcctacctgccgatctgctccaaagagattataaaatctaagaggaatgcctgggtgtgtgggcgggggggcggtgggggaatgtagagaagaacaaagttccttctggagctttgggaaagccgtttgtgagcctggacttcccccagcctttgaatcattaatctggttgtacccaagacatccaacagggtgcagacttgcctcattgctccagaagctgagaccacccccgtaacttgtgaggacggaggtcctaccccctgtgaagaaggctgagacacagagaaaactgagagattaaatttataatcataaccttcctctggcttccagagaactacaaaacaaggacacattcccactgtctcttgtcccaagagtagagccaaaccaaatagcctcaccatacccaacattatgcaacttgaagcccaatcaattggctccacccacatttcatctacaggacattgttgccaaacttcttaggtatcttcaatatgagatttttaaagagctaaagatataacagaaaaagcctcaatggaaattttacggctattttcttttgcggctcagggaacataagcttttatcattttccttcattcaagtaacagctttgccctagctccatggttgtcatgcatggtccatggtgctgctttgatgatttataaccagctgagtcatcatctcactaagtcaaaagagattagtatgtgaacctatttggtaaactgtaaggcactacacacgtctggtggcaaggcttgtaaagctctaaatacacgcataattaatgtgactactccccaagacagatggtataaaggagacgacctctacctatgaaaggaaggggagaagaaaagatcaaaaccacctccttctccagccaagctatgtttgctctcccattcctctccttactcccaagatctaaacatgacaggagtggagaagggaagatgtctttaatttcctggttaatttctcctgcctggattccaagatggagacccaaagggagacctgtgtgataactggccctcaaaggagtgcacacagtagacccaggagcaacagcaaaagttgctgactaaacctggggacagcaattggtatccatccctcaggcatttactttgccttttcctcaccagtcaacttcaaggcccttgaagttgtcaagaaactggcaacctagacatttatatccaaaccagatccaagaattgtatcgtaagaatggaacaataattgaaccttgtgtcccctgctaaaccagagagagcttgtcaacaaaaaggactgagagaagaatcctggggaacgggctaatgagaaaggctacctgaaccttcagaaatacctggggagcttattttatttatttatttattttgagacagaggttcactctcaacgcccaggctggagtgcagtggtgtgatctcggctcactgcaacctccacctcctgggctcaagcgattctcctgcctcagcgtcccgagtagctgggctacaggcattcaccaccacgctcagctaatctttgtacttttagcagagacagggtttcgtcatgttggccaggctcgtctcgaactcctgacctcaggtgatccacccaacttggcctcccaaagtgctgggattacaggtgtgagccaccgtgcccaaacttgcagcttattttaaatggatgtctgggctgcactgcagatctatggtgataaggcaggagggggcaccctaactgaaaaaaaaatctccagatgattccaatacccagctgagtttaggtcctaccacattaggtgacctcccaaaggtcccctcatttgatttccctcccacttccacactgaacaccagcaagtccagagagaaatggccctcggcatccagcagagttctttccagtgcccgccagagtgatggccaccaaaccttcctccagactggctcccattgtgtgcagggcaggcaggacagtctgtaagagatcatcactgtggacaatcggggaaggagctggcctgggcagagactgccctgaacattcatgggacctgcgccccagagcatcagatgggcctctctgctgaaggaataataaatatgtcttttgaacaactgattttgttgttgttgtgtttccacacatatatgttcaccagtgctggtttcatagtagttcagtcgtactgcacaggtgagctagggggctttcttaaaagccagaagactatttaaatttagatttgcatgctgaaatggagcaacttttggcatgtgataaagatggggaaagttgaagaccacaccctgcaacgccctccctgacttactactaccacccatcatctcccattaaaagaaacaaaacaaaacatcattctaatgccagttaaacgttgcatgtattgattaagccttccctcccatctgaaattctccctaaggagtaacattttaaagcttgcagtgagggtcctaaggaggctgctgctttgacagcctgcatgagcagcagaagggaccttgctccctaggccagcatctggatttcccatctggcccacgcctgcagctgcgtaaccctctggcccccctccaacgtgcctcaaaatgttatttcacattttgggtccaaatggacactttctgagaagtcggtgtaacctatcaagctttggaaacaagtttaagttgtttttgtactttccattacccaggttgttctggaacgcagctctaagaggttcagcttgccaccacgtcaaggaatttgagaaaagggaaaaacaaagagggggaaagcctgcacaagaagaccgagggtctggaaatcagaacctggtgttttccaaaggtcctgttcagcctacactccccttttccatttctgccatgctgttggggcaaactggcatgggaagtaggggcttttgtcctaaaggcatagcatcaaggtccccagagctacaaggctctccaattccttctccctggtcccgtatcatcagacaaacccaatagagtgattctctaacatgctgtgctcagaaaggtgaaagaaccaccaggcgtggtagggaggctgtgtccactgttcagcccagtcagtgtggcttctctccctgggctgggctccatcagctcatgctgagcctctgtggcattagaaaaaataatcccttggcctcagggcctgctaagggacttcaagccagatttcattcccattcacttcctaagccaggtaccctgtgcagggcatgagagccagtggacaggacgcccctgcacttgggagattcggtaccctgattaagggaaagccacctccctggctctggggaaggtaagagacctgagaaagcaacagccttggatctcactacattttgtgggctacttctgaaaaccacactttgaattccagtcccatcactgaccagctctggactacctgtgactttgaataagctattcaatctgtgcctcaactccctcccccatacaatggggaggatgttagcatctatctcacaggtagagttgttgtgaggactaggcagagtaatccatataaggcactctatcattatgttgttagatcagtttcaagaagcacattttccaacataaaatgatttgtgaaactgagatcttataatcagtccatatgttaatacatacttaatagagttttctcccaccgcatcctccaaaacagcaggtattaaatcaatggtgcatctttctcatcaacgtatttgagttaagaaaatatggtcttttaattaccatttcatgcatagtaatggctgcaatgttaaagactcacttcttcctgggtaattttgcagcatagtctctaccagcacccctggggatgtaggtgcctaccaagccaccatctcctttcttctccagcccctctggactccttcaggtgctctcaaacctaaactcataaaatccttgccagatccttagggagcatccaacaagtggttctgagcccgagctgctcacagaaatcctagggcactcgctggccccacaggttctgattccattaatggaagtgaggcccgggcatcagcatttttaaaagctccccagatggttgtaacatgcagtggaatcaagaactctggctccagtctgtccccacctccatctgatgcctgaaatcccctcaatccctgcagctaatgagtagctggccagcctcttccaggagaatcaaaacttcactgacttaggttgcagaacaccataataaagcagaggttcttcctcaggcagtgtctttgttgttctgagataaagaaaaagaccttgaaggcaattctaagctgggaaatgagaaaacctgcctcaaatggagtccttcttcccagccatcttaagctcagatacctggaatttatttattttgaactttgtagaaatcttttgacttacaaatgacctaattctctaaactagctatgctgagaatgcaagataacttttatgctggcttgattccataagaaatagtgactcataaggatcatcatcagaaataaatttctcaaaacttttaagtaaatctgtttctaggtaaacttgatggacttttgaaggattatatttcccccttctttttcctcttgcatccataccaagctcttttctttatggcagaccttgtttcctctccatcttctactttcatagatacagtccatcaaatcatacacatgactcatttcaccaaccacgaagattctaccatgcactggagaattagtgagttggcttcaactgcacttcaattgacgccccggaggtgggtaagcatacatttccacatgtatgcagatagaaaaatatctgattgggcactaaatgtttaattctctgagaaattggcaatccagtgagaaagctacgctaggcatcctagatgcttttagatcacagtaatggaagcatctcacaacagcctaatgttttcaacccatcagaaagcagagtcccagagagcctatggggactcaaaacaaacccaactaaagccaggtggagtgacctctcatctcagactccaaggcttgggagtaggaatgggcaaagtggagacaagctgccaaatattaggggtgcgccatgtcctacatgttggatgggccctttacacatgccatctcctttaacttccttctcacagtaagtggggagacagagattagaatcaggctcgcataaggtcacaaagatagtaaacagcagacctaggacttagccctggtccctctgatttccaagcttccttccaccaaatggtggagtaacttgctcccaatccatggatccagacctgggaaaggggctgcttctctgagctccaggagctattggttgagaatcctctcttttttgcatccctgggttgctgcccacccccatactgctccttaagcacttaattaatggtgtcctgtggccagtcctgatgatgcagtttttcttggtcactctgtgggccacagacttgcagctgccaattccccctacaagcattgctcgggtccaggcccactgtaggagacaccctgactactccggtgcagatctcacagctaccatgactgtttgttcagcccccacattctccagggtcccaatttcttgtcccacattcaaaaagaatgaggttatgctgccagccagtgggtgagcaaggtgaaaagttttattaactgatgaaacagctgtcagcagagaggggacgtgagaattgtctaccacccaaagtcaggtagtctctgtgtcccagtgtggctgagtccagggtttttatgggctcagaaaggggatggatactgattggtctgtgagtatgcaaaaaaaggcaacagtgtaaaaaccaattggggaagggtgggtataggtgaagaggtgggggttaatcagaggaaagcatgccaaatgggaagagaggttctcaatccagtctgtggatttatccaagacttgtagcttggctttcagactttaaactggctttggtttgcaggggggggtttcactggggactcacctgtgtttgcctagggatttgtctacctcctgctgtatcactgagttcaaatccccattctaccacttgccagctgtgtagccttgggaaaattactaacctctctggcctcagtttctccatgtttgaggtggaaataataatacctactctgctctgaacactaaatgagctcatttacgatggcatttagaagagtggacagaagtgaatgttccttctcccattattcatattgactccaccagtactgtctcacagggtcactgtatcatggcatccatctttccatgggtacatgtcttgtatagtccttaggggaaggtcttgttcttctctcctctcctcagggtccactcacttatgcattatctcataaaggatactgaagcccattgagggcatttcctaatctgaaggggcctctgatagacttctactacttaagtctcccatcactttcccacccttaaccccattctagaaaaacccataggtaaacagagtatacctgattttctaatacccattgaatattttatatttgtttttatactttgcaatgaagaatgtttcagtaaatttcctaaaggaaacaaaaaactcatagatgatataagtaagccatgtcacccctgggcttcctccaccttccactgtgtactacaggcagcacagtccctcccatgctgtgctctgaccttgcctgaccttgccaccctgagtgtgacctgcagaccagcagcatcagcatacccaggaagtcagttagaaatgtgaattcttgggccacagacttaaagactcagaatttgagcccatggattcttgcttcagggtctgtgctcttcgccaccacactacactgtttctctttatcagcaatgaaattgagaacagactcattgcaagacgctcattgtcagctccgtcctctactgacttcaaaacatcatcagcttttcacattaaatttgtttatcacccgtctcagatactatctttgatatcagaggtaagactggcattgtggacagatgttttcatgccttgacccaaaagggtaacaaacatggatactgcaggccaacacgaaggaattgtgttgatgggccataagaaccacaatgggtcccttaaaccacacctcagctacctgatttcctgcacatagggccagaaatatactaaggggaaaatggtagaagggaaaatgagaacaagaaagaatgagataccctgcaggtgtcttcctctactagggaggcccctgagaaatgactgaatgtttttagcaaaagattagaagaataatattatcttgccatctgttattgcttatagagagccaataagtgtgtcttagagattctgagttccagggatgatcccactcaggttccctgacccactgtgagtcatacctccatagcagaggggcccctaaccccaggatttccatgccttctgcaagctggtcttttagatttcatcagcagtcagtcctgtggccatggaacggggaatgatcgatgacagcccactgaaggaggaccttcttcttgtttgcttggttctggggaatgcatctcctaggcaggagcaacacgtgccataatggtaaaataatttgggaaaaaatggcaaaaaatatttgcttttgccttaaatctaccaaaagtggatcacaggttgaaaactgcctgatcttggtcgttcgaagcccctgagtggctcagtatttgaactcagtgcagccctgagcaaccaattaatatttgcccagtgggcaggattgacttcagttacctaaagatgttactactgctcttctggttgcccagagattcccacaccccgtgtgcagcacagatccagcagagactccttgccaaaggccattgcggtccaagaccccaaagaggaaggctccagaggtgactgctgcttgggaagtcaatatcggacatgagtgctagaaccaaggtaatgcttcccagacttcactatgcccaccagagacctggagagcttgttaaaattttgactgctgggccaagagagctggggctgaacctgagaatctacatttctaacaagtctccaggggatggtggtcgatggaccacactgagaagcaccatgtctgaaaatcttttgagccaaacattttatttcaccaatgaagaatttgggaccagagaggctaactagtatgtccaaaatcacccagcacatcagtgacagggttgggaccaggtgccctgactcctagtttccactgtgttcccactctatcagcttaccttaaaacagcaatcgtcatagtcattttatgaactataactcattttgagtaccaaatgcttttcctatttcctcttctttatctttataatcaccctttgaggttgagggcatgggtctcaacttatagagaaagaaacgaaggttgaaaaaagtaacaacaacaatgaaaattggctctagatcacaagccaaggagtagagctggattctacccagttctctctgaccttgtgctgttcctctttacatctcttcaggttctcagaggggagctctctctaccaaaggtttaatgcaagacccacatagtcacctagcttacggaaaggacaggcctgaagactagggtaaaattaagatgataaaacagtgaacaaatattttaaaactatgtccaggaggaaagctagaggaaagagccctaagccccagctgctccataggctacctgtcattctctttccaaaacctttcaggggtttaagacctagaaccacgtgtctgacaccacagccctgtaaattctgtccccaagagtcctgaggctctgcgcaaacaaaattaatagcctgcaaactctaaatgggtgattacaatctataaagcagcccataaaatgacatcatggggattcatatttattttctcccactgatttccactataaatttgcttggtttatgagtagaaacagtttcttctgctacgtgcctgggcataaagctcacctaaagatggaaacctaaagatgtctggggctcacttcacccccagtggtgctctggtcaatgggacacacagaagaaacctcccaaggaagctctggaaaccccaaagcagccactgcctctacaaacatgccctgagagcctgctgagctgcaggcttctgtgctaggtcttgagcagtagccaacaaaatgggggtggtctctgccctcagggaccttgcaagggtccctgaaagggaaagaggagacagacactaaacagaaaactacatggataacacatgggggttcattagggaatgcaaagggaaagtacagcaagctatgagctgtggaacaggagcagctaacctgatctggtaggggtgatgcccaagaaggatgagtaagtggaggctaagcaaaaggtggggaaagggagaagaggagagacattccaagtagagggatccacatgggtagagcccagctgtttgctgctgttgcagttgagccacatgagtatcaaataaagaatgacaaaaattctgggtcagacaacacatataggatataataagattaggttttcttccaagtgcaatagaaataaatgaagagttttaagaaaagaattaacatgatcagaaaaccatcttagaaagattctaccagccgcagttagaagaatggatttgacagagagggggtgtttaggagggaatgtcagcagatttgtaggacactattgcagttgtctacacaagaagtgatggtggcctgaactaggtaagaataaatgggccacagtgctatctaggaggtaggaccgattagggctgtcagacccagcttacgcaaaaagggcagggcatttaggaggtgcacagtagataatggtgatcactgacctactggcacttgcaaatgctttgaatccaatctcattagccaaggtcaatacctggaagccactcagaagccagtattggtacgaggtcaagtgaccacctcaccagtgcaacatagcacacgcagctcaagtcatccccagaccagttgacactctcaacttgcaaaagaacacatgaggtagaatccctttcctttaatttaacccaagctctactactgcctcagttcaaaggtcatcaattgcaagatcagcagaaggggcatggctccctgaatcccaacaaggctacaagggttttggttttacatagctcatccaaagccagtctcttctggccttcagaaatttctccctcttccaagctccaagggcatttatatcatccctgtacatgcagacacagtccccaacttacaatggctcaacttatgattttttgagtttacaatactccaaaagcaatgggtattcagaagaagctgtacttcaagtacccatacgaccattttgtttcctactttaagtgcaatattcaataaattacatgcaatgttcaacgcttatcacaaaataggtgttgggttagataattttgcccaactatgagctaatgtaagtgttctgagcacatttaaggtttaaggctaggctaagccatgatgttcagtagatggagtctcgttccgtcacccaggctggagtgcagtggcgcgatcttggctcactgcaagctccacctcccaggttcaggccattctcctgcctcagcctcccaagtagctgggactacaggcgcgcaccaccacgcccagctaatttttttgtatttttttagtagagacggggtttcaccgtgttagccaggatggtctcgatctcctgacctcgtgatccaccctcctcggcctcccaaagggctgggattacaggcatgagccactgcacccggcctaaacacatttttaacttatgatattttcaacttatgatgggctatcaggatgtaacaccattgtacgttgagaagcatctcattctaccttgcttagattcaatttggaatcacaacttaggctgccattgttgtctaataattgcatgttcattaacctgttttccaaaaagactttaagccaccttaagataagcacagcatacccagcgacaaggtgctgtagatgagcacctactaaatatcagagaaagaagtgaattgactgggcccagaagagaggaaaatgccagtctggtgatgccagaccaacagagaggagtgagtgggaggacaggctcagcactgaactatctagagttgcccttgagtcctagccaagatggctgtcactccccaggtgcccagagatggtggctttcttgagcaattgatctgaaaataggtcccctaagcagaccttgtcactgaagttcacacactgcccaagctgagtgccatgctgagcatagcccagatgaaatgattgctcatcttgagggcaacatcccagacaaaccagtcccttttatgtctcactcactatggagggaaagcccctgctctcttgccctcaaacattagatgggcttacagaaatgcattcccatttcataatgcctgctgtgattccaggtaattcctctaagtgcactattaaatcccagcagctgttccagataacagcaaagtcgacaattccagctgccgccttgtcaggaaatgaagcaaagcagctgtaagtttcctaacactgagacatgaccaaaatggcagcatgagggatcactcatgtgcaggtttctccaccgccatgcagataatgtgtgtccaccatcacacatacattacctgccctgagtctactctgatgtctgaggctggaggactcaaaactgtgggccatattcccctgagatacccagctacagttatctttgagatcctcatgagaaagaatcccaaattaacactgagcccctacccataaagcatgctcaaggtgctggagaattgcttaaggccacacagctaaaatggccgccaagtcaggatttgaactctgatcctgtgagctccaaagcatcaagcttctctatccttcactgttccctactgctcttaaagccctgtatttcccttacccaaaggagcccggccatctcaacagtattttcgccatctgggccaaccacgtgccggcagagtgcataaataccacttttgtgaccaaaactgtatttcctcggttgatccaacatcagcatctttgcacctgcaactttccttaagaagaatttttccatgatgtgatgacagaatttgcagccagcaaaggggatcatagacatacatgtacacacgagcccacaaccatctacttcaaagcctcccagcctgaagtacgctctccagatgtctctatataccaggtgcttcgaggctggccagcatctccctgacagcagaacaagttagtataaggaatttctatttaaaagccaagttctacaaaagctaagccaagcaaggttctaataaacagtaaaaccgccacgttgtgacacatggcttaaagttggtcactcacctaggtgggtcagaaagacaccaatgcttttcattttccccagcacctcaaccctggttagtgctagggtgggatccctggtgggagactccacccacactgaacctggctggcttcacttttccagactggtgtgttctccaggcaaatatatattttccccctacccacctccctccgtgtgactcagcaagcaagtgctgggtaggaggagtgctggtagggtgggggacgactctgttctcattccaggctcaaggaacagcctcagtcatggacaagaagtataggcagagagtcaggagaccaaggctctagacctgttgttgatgactaagatggcctgggatgagtcccacagcctctctggtctcagttcctcatctataatttgcaggttgaatgatacctgaggctctgtgattgcttgagtcagccaacagctcaatcagccacacagaaacaacctctcctcttctctcttccagcctggataaagcttgtggggcatgagatttatgggtttggtgctgaattgcatcatgtatgaggcagaatttgagttggattttcatgggttgggaggatttgtaaaggcattgaaggcatggggggacatgagtggcataaacaaagaagtggagtcaggaatgtgcttagcgtctttgaaggaaccactagggatgataatttagacagcgtgcactagtacaactaaaccagtctctcaaatattgaaaccttttgtaccggctggtaaacagccaatggccttgacttaggagtgccccctcagctgcccctgctgctgcagtgcctatcccccatcccaaccccatgatccaacaaccaaagggttaatttctgagatctcgatccaaaaggtgcccataccatggtgatcctagtcagcccaaagccacaccacacatctaacaagcattcctgtgtgccagataccatcttaggcacattaacatatgttactttttctccccttcacactaacctcttcagattaaggaactgaggcttggagcagttatgtgacttgttcaaggatgcaataacagtatttgaacaaagaccattaaatccaagtccagagctcacttcttaaaaccccagctgcctctgagcagccttggcccgcagacagacgagctttggaggaaataggaggaatttctccctgctatggagattgttttaagatcatgaattgttagcggaacaagttgtcgtggcagcttatgaaatcaccctcttctgcgatttttataagtaagaggggttagaataggcccagagacagagggagagatgaaatgacctaataaaaccctttccaaccctggaacacttcagccccacatgaacagaaaagtctatttattttcaaagccccattttaactcctgaagtacttaggagacttaaatatgtctgaaggcaaaacaagttccctctttttcctcttttcctaccactccaactcttcattgcagattttcttcctgcaggtctgacaaacaccatttttggccacagctgctgtcagttcaaaagtttggctctggggtctgaagaccaaagtctgtccaaggctgatcaccttctgagaaagactcttaaattctgtgaagagtctccagcagaggagaaattggtttaaaaaagcaagaagaatcaccacaatgcatgcccactccacattaccaagcctgcacaactcatgttaggggatgtctgctgctcctccagctttctcccctggcaaatacagtggtggtccctgagtccccattagggcccaacagcaggaccagtagcagcccctgtcagagaaaccacagccagttggggagagcgaactcatactataggcttgtttccatggcaacagatgctccctcctccctgcttctcggcaccagggaaggacaaggaaacccatgagaagacagtggcaactagggggaggaggaatggcagcaagtcccctttctttgaaacccaggcagctgctgccccacatgttgatggttacagctctcagtgaccttggacaagttatgccccagctctgaactttgtttttatcatttaaaaaaataaataaataaaaaagatcaagagattgagagagagagcaagcgagctgggccagagatgatccaataaagctatttcagctctgatgtcccagaatccaatgatttgtctaacctggccagtgattgggaatgggttcacctcttcttgcagccctctgcaggagcatgacattccgcaaggctggagtggatctgcctctcagggacctaagccttatccattcccccagtcatgctgcctccctcacaatggtctgctgtcatttctctgaaatcatctcaggagatctatcccatgctttcctaagggtgcacgggtttcctggggctcacacaagccatccaacatgacaggtgagccagaatgtcatggcaccgcacccagccacttgcctcccacctcactgatgttgttggattcaacctgcaattcagatgcacacagcccactaggcgctagcctgctatgactgcgcaagcgaaggaactccagggagaacacccagaaaggtcattttgtttggtatgaagagtgctagggtgaggtgaggggcagggagtgggacagaagcttcccaggaaaaggggaaaccatgcacagcagccaggagccatggactccaataccccaaggtttggaaaagtacttgtaattttggctgattgaccaaaagtggaaagaggagtgtagcatgagagaagggaagagaggaaggacagaaaagtggacaaagaattccaggagatggccggccgcggtggctcatgcccgtaatcccagcactttgggaggccaaggcaggcggatcacctgaggtcaggagttcgagaccagcctggccaacatggtgaaaccccatctctactaaagatacaaaaaataactgggaatggtgatgcacatttgtaatcccagctacttgggaggctgagagaggaggactgcttgaacttgggagacggagattgtagtgagctgaaatcgtgacactgcactccagtttgggcaacagagcgagattctgtctcaaaaaataaagaatgccaagaggcataaaaacacggcaatgcttccagggctggatttaggggagaaaagggagtactcattgttggaagtacaagccacatgcccagtgctagcttttatgggagtagcaggggatagctgagggccaggttagtcactgagccctccacatgagcctggtgggggtgtacttgtttccattgtatgcatgaagaagcagcaactcagaactacagcatgatttcacctagtaggtcagctaccccttttctggagtatacaatcttgctgggggacaaaataaacaatcatggacaaattaccacatgatttaaaaattgacacacggccactctcacaaccatcctcagaaatccagaagttcagggaggaacaacaacaaattggacttctgaggacttcctgttgccagtggactttaagaaacgttcagcctctccagcgcaattcacccctaacctatcagactccgcgttggtctgtgatggctcatctctggctcggaaatggttaaacagttcatttctgtgcttgaatcaggagcttccttaaacgctagcataaagctggtctacacataagaaatctgattagctcccagcattgggcaatcccaattattatgccctgcaagttgctctgcaggattagcggtctgcggaagaaaggaatcaatatacaacagtaattagggctcctgatgccggtaagaggagcacttctcttccccttaagccactcacgacagagtccatgaggggacagggccttcacagcactgccagtctctgttttctagcatatgttcattttgactttggtttttatttactgaaggatgtgaaattctctgctactgggccaagactttagggctacatacgtcacccaagaacagcgaacaggatgtgtcatgcatgggaccttccttccaaggaaactcagggaaagcagatgctaggatcctggcaaccccaggaaacctaatcagtgtccctgtaaccaagagctctttgagaacaggggctgtgtcttatttaccttatatcaatgtggcctagcacagtacctggcacatggtaagtaatgaacgggatggatgaggaagtgaatcaatgagtaagtgaattaataacacatggttttcagtttgtcaaaaactttatctgtgagcctgctgtgcacagaattttgtaccctaatactgtagtagcaatttacattggactcacaggatttgggggttaaagggaatttgaatataacccaatctggtatttttaaaatcacaggttgcaacctattagtggaccatgagatcagtttcatgagtcctgaccgtcattttataaatgaaatgagaatggaatgaaatgaagtggagtggagtgggatggaatgagatggaactagcaggaaataatagaatattccagaatagaaactatcaaagtacatcacatgtagtaaaggtgagtacaggaaaattaggcttgtacttgcagggcatgagtgtgtgtctattgggtgtacagtgtcttaaggccaaaagccactgatgaatctaaccattcatccagtgattttcactgccctcagaggccacatcagggacaaataattttcctttttgatcccctcttgttacaggaaatgaatttcatccagaagcagcctgtttcacttacagactgtctggctgcaggaattagggcaaatcagagatgttatagaaagaaaaagaaaatgtttcctagatcaaaacacccatctaagtgctggggccatagagatgagatcgattccattttccacatgacaaacattcaaagattttagaatgtcaattgcgcccctgctgaatggcttggagaagagcaggaatagttctagttatcctaacaattgctcctaagatgttgctttgtacctgctcgttatccatcttgattgtgtttatgtaagttccagcccattcatgacccctggtgtgtggcatgaagaccatcacatttgagtctggtctgaagcttgtctgggtgatggctgaggtgaacccatgttagctcctggtgctcaccaactctcttcctaaaagctctcacattatctgttcaaaagcctgcatccacctagcagggtaatttcatcatccctgccctctcgtctgtgaataaacagcttgaactaatagtatttttcaaatgtttttgaccacaaccctcaggaagaaatgtactttacaacatggttcagaagacaccaccacacccccaacacacacacacacacacacacacacacacacacacacacacacgaagcaatgtttacctttactatatataatgggatgtactatgatgttttattctattctgcttcatttcttatgatgttggtgatgacccattaaatagatttcacaagctactgatggaccatgacccacagtgacactgaactagatagtacctaataatctgaaaaggcagggaagggcatctgggaagaatttcacaccaagcccatttcttttcattatgtttatttagccatgtgcctacgtttggttgtgtgtaaaggaagacaatggcttagtgagctgcagccaggctgttttggggactcacaaaggaatggtcacagtttcctgcctgtctcttattgccccccaggcaagctcattgagaaaagacagtgtgagtctcgtacagagcatgctgataactattacagatacgtgattattctcggttctgttgatgataacaacatagctgccatcttgtgtttgtttcctcttaggattagaaagcaaaagcaatctgaagattgaaagtcagaagcaaagttagaatggtgatttttttcccccaacccaacttggaagaatttgtctttggagaaccaacctaatcaaataaagtagcatcaatttactggagacataatccaacttgcataattgtcctggctggtttacaccacagctgttcatatgacatggttcattaaataataaagtcttcatcaggctctcctgcactgggctgcaattcttttcccccacaccaccaaagaagtgctgcctttattagaatgcagtgccacccattggcagtgggataatcaggggatttgtttttatgtgacattctattaaccaaacatcataaactgcatcaagtaaaagccactgcattttccccagtggaggatcccatcaccacataatcattctagactgtgggttctctgtgggcagggaccacatcccttcatctttatattcccagtgctaagcaaagtactcagcattggtgggcgcaagataaacatctattgaattaagaggaaaatatctccagtgtgggattcagaagagcaatgcttagaaacctggaggctccctggttgcaatgagcatttagtgtcttgaatactgtgtccctttcctttctggtttattaattttccacttgactggaccaaattttccaagtccacgtgatagcagacaggactctcaaaatcccctctggccaacagaaggttcaacaacaccaattttgctgtcttcaagctcaggagccctgctgggcagcagggaacctgtgccaatctcagtcttcctaaagaatcccacagttaaaagaggccacctgaaaatgggctgctgagaggtaacgatgaccttggaaatgtcctcaggtttgggaagtcagcaatttggtttacaaagcatgaaaaggaagactcgttgtaaaatacagaagatttaccagcttaagtagtttagaccaactcaaacttgagcttgagcctgcacgggactctcctggagggattgttcaagcacagagggttggcttcaccctcagagtttctgattcaggaatctgcacctctaagatccaggtaacgctgctcctccaggcaccccactttgagaagcattggtttagcctgcttattacaagcaaggctctagagctggctatctatgctggaaccctgaacccaccacctcagccaataattttaggcaagtcatttaaactttcccatccccaagatgcaagtgtcaaaccaaagcaccaagaggatctttctcacgagattgttatgaaggtcaaaggaggacacccactgcttaggggtgtgcttggtaggtagaaagagcttaattaaagttaaccacataaaggaaagtagggatatggtctgggggaaagactgctggtcagagaagccagatatgcattctagctctagccctgcgaccctgacttgctgtgtgaccctggacaagtgacttctttctgggtcatgccctcattcataaaatggggacactggacattctataatggactgaaggtgccttggcgctagaagcttccaaagctccttgctcctgactctatcacacagcgtcacgtacctgtagtgccttcccaatcaccccctaccacttagactgccaactgccaggccccagcaggataactcaagactgccttgaagacattgtctggttccttggccttgaagggtctttccacttggccacaggtgaccacctgactcaccgaatgtagtctaaggaacccacttccacctgggaagtgcaacctgggatccttcttgctgaaaccctattgcactccaccaagattttgttcacgtttcatttgtagccagctccactcatgcctctcattgatattcttttgtggttacattccagactggaagataagggaattcattgaagtgtttagaagggacaagtgtggtttcatcgggagtgttatgctcagatgagtattggaggattagttggggagagaatccacactcgcagagggagatgaggttctgaaatttattatcatagcctggttgtggggaagggagcctcaggaggagggttggaagcccaaattcctaattgaagatgcgaagcccattttcatcttatatttttattagccccatagcagcccactgcactggctttctgctaacagccgatggcagggagaggatgcttgttggcacaaggccgctgtacatttcatttttgtcagatgctggcaaaatttcctcatcagggaagataaattcgaggtgatattaataaacctctgaatgcagcaatcagatctggctggcactcttaatgattccaccagcagtgagccatttccagcctgaggagcttagagattcacggttttgtttaaggcatcccaaaaactagaaattgtttgcttgactcctgggttgagcccgcatcttcaacctggatactcccaggtgccccaagtgaggcagtagtgatggaagagaggcatttacaaaataaagtcttgggtaaatgttactcactattgttttgtacccagaaagtgctaagtgtctcatactatctcgtgtaattaccataggctcagtgatggaggtactatttttaggtgaggtcactccaacttagaaaggttatcattaacaatattggcatcatcatattgcaatattgactgacactaagtgctttctatgtgactgagcttaggattttacctgcattttcacttttcatttgcacaacaagttatcaattaagcactgtgatcgccaatttacagagttgaaaatagaggcttagagaggttaaacgtgaggctcaagatcagactcaagatgcatagccagtgatggaatccatgtgtgttggattctgaagctcatgccgccatggactgtgcttgttacggctcacaccaccatggactctactgtggaggcacaaccagagggccccatgggtctccacttgtagaaggcggttcacctatcatcctaccttctagtatgaaagcagcttgcactcataggcaagcttacagaagggtgcagccccagctcttgacatagaaccaagcacctggtaggcaccctttcaatgtttgataaataaatgaattgatggtcagtccctactcacgtcctagaagatttgtgaaaggacagttgaaattagtctcctatgctgctgtccacctcttggtatcttggtggacctattcaccaagggccaaatgtccctaagcacaggtgagaagagttgaggaaggtttttgtatcctactctgagagcagttggagacttcgttccttggcttagaagtcaagattggatgcagaactaggcaagttgcttttctgagcaaagagagtgctggcccaccccacatcctcccctggctgctggcccgctgcaagccttggcacacaagagaaggaggcagaagtgcatttgtttattcattcacccacaaacatgcctcaagcaattgagcacctactgaggccagagtagttttgggctctgcggagaacatacatataaataagaaaccatccttgaccttgaggaatttataagctaggaggaaaaataacaggtacattaactcaggtgtcagctgtctctggcttctccagtgcctaggcccatgtatacagcatcttgttttgccctgaataactttcatcctgaaggttacacttttttgagcttctccctcttgtccctcatcccaccccatcaccaccccatgccattgctccagatacaagcaaaaaggaacaacacagactgttgaagatttcacaggtaaggcagaaaaggaatttaaatcacatatctcatggcaaatgctctaacagattttgagtttgccttagttccttccaggccaaagcacaaccaaggatttccttccctgaccttttcccacagagttccttgaggtagaaaggtggctccaagaagcccaagtccttcactcgccctccaaaagcctcaccttttcactagagcagtcttcaccccttgtagatgtcattaaggatattcacaaatactcctattacgtcctctttctgggcaattgtaggattgcactttctagtttcctaaagttaagtgtggctgagtgctgagtggtttgctctagccaatgtaacatgagccacatgatgcgtgacacttctggatggaagctcttagccagagcagttcaccactgcctcctgccaagacggtgctggaagcaaagaccaagaggaagtttccatcaatctggtttgctgagtgactctgatgaacagcctccaccctcctactggcctcctaccttcatgactgatatatactgtattgagcaagaaataaacctttcttgtgttatgccactgtgggggctgtctgttactgtagcagagcatggcctcacttgactgatactgccctcttcgaagcagaacaattctgctttgctctgacctacagtcagactttcacactaaaccaaggtgggcactcaccaaacaaaagattctccaggtaacacaatctacactctgtggatggaaagttatggcatcttttgatggtggagcattttccttgaggtcttaccccttactccatgagactcatcaacatattttttctaaacaaaatggtggagaagaattctggggaaagaattctggggaaagagtgtctggcacaaaagaaatatgctctgggaagtgcatgaaaaaggtaagtgtcaaaacagtggagacacaggaaatagtagcattaatttggacataagatgtcttcaagaagaaagtgaagtcccccaaactttcatgcaggtttctctgcaaggaaggaaggggctactcccctaagaacctaattggaatgtggctctgggtgccaaagctgaggctgagaccctaggcacactcaaagaaggaagagggagcttctgtggctctcggtgctctgcttctctgggtcaaacccttcttgccacacaggtgtgggagcctgagcaggccagtccactcctgccctcctttcagcccactccctgggccaggatgcacacaggtatgtattccccaatttgagccctgcctcacttcttcctcgttgttacctgccagcaccaccacacttgagaacagcagacacattgaactaaatatgatatgatgtaactctagcctaggagttacagaaaaaaacccaagcacatttctaaaatattcgagaatcctgtgttgaatgttaaagaaaccaaccacataggatctttataacacaccaaggcaggcactcacggcctgtcctgaacaaatccaaatcttttatccctggaacctacgtcattgtccacctccaggaatctgtgctgttgagctgacggctcctccactacaatgttctgctcattcaagactctgtcctcagtggttcatctccctcattcacatcccccatcaaaatatgtctgacttgtatcctattctttcagggcctttctaagaaaattccaaatgtactctagcagcttaatattttgccttccctaggcaagatgtttatatttaatcaaacaacttctgggaatgatgtatgtttagtgtaaagatatgcattactcagagtggaaattttcagtatgcaacagatcataatggacagaaggctctttgtggagtccgtggcttcaccctacatgccattctataatatataccacatgtgccaaataaatcccctaaatacagctccaaaaataacatatcagtatccattctcaagtaagcgacttctgccatacccagaggagaaagcatcagattaggtaactctgcttagtggtaacattctctaaagatgaaagcacttttcccactgacagaagcatggctccaagaagcccaagtcctgaggatattgtcagtaaaaccacacacacaggtcacagcttgttattaatcaattaattctcagcttgctttgtcccaagtcatccagcagacagaacaagaagagatttacaagctgtgtgcatttaaattaatatttttaaatggcatgagtgtgcaattaatactttcgaagaacatgtccacaccagatcaggcagtgtcggtttttttttcccctgtccatatgagtctatttttaattcctttcttggggaaagacaacagtcctagatttgttttgttttgtgtttttcttctgagactcaaaataaccatgttctttctgcttcagtaaatcattactgcagcttgaaagggttcctagaaagttctagttccattcagtttttaggaggaaaagcaacccaaacacgccaagaactagaagctttatccacaagggagtacgcttcaggatgataccaactgcattaatcaggatagacaaggttatgctgcagtaacaactaaaacctaaaattccaaaggcataacacttaaacatttacttctcactcaggaaaagtcactttgggtctggtgactctccaacacagcttcctttaaagagatgactcagggattcaagctgattgtatcttgtggtctacaatctcaatgcatggcctctgcaatcaccatgaaaggccaagggagagcatggagaagcaggtagaggcattttactgactcggactaggagggacatatattatttctgtgcacaatccactcaacaacaaggggccttggaagcatgggagagtccacaagtatttgatggttattaaatctctctttacacgggttatctcatagtgatgttaagagacttcatgatgttgttactctacttagaaactcttggatttcagcccttgaagaccatgctccaacttcatcatcaaatcctcaccagaaaagacaagaggatacagaacactgagcaactcacaagatgtgtgctgcagatgtgtttatcagaactcaaaagtttcctctcttttctctgtcctatgactattccaggagtgccagacagaactagttcttacgctctgcgaagaaaagagtggactggaggtgggtcacattgacattttggtaagagccctactccttagaaacagaatgaaagttgtcaatgaggggaagggagtaaggactggctaagagtagccatgctgggaagatttcattgcaaattttcctctacctgggagctggcagataaaccagatcattgttcccaaacactggaaggaggaccgactgttaaaaaaaaaatacccatgctggagcctaaatactctatgctagagcctggctattgacatattagcaagcatccctgggcaatccaatgcacagtcatattttgcagtcattgcactaaaggaatatccaaggtccccaccaacactaggatttcacaatttatgagcattttgaaagaatttacccctgaggattgacttattcagcatttaaatgggaactaagaccacgtaattgactgggaccaaaccaagatcagaattcataacctcacagctgttcctcatgtcaactctttctattctaacacactgccatcctcattttaaaaaagggaatgtggccttgatattcccatagattgctggatgcatacttccctgtcaccttccagtagggacacaggcattctattagctcagcagaatacagggctcccatccacatctgatggaaggcaaaggagatgaaactggtctccatgttgaggacagactggtacattaaagaagcaataggtcccctcatttgtacaccaagactcaagagttgaatctttcctttagtgacaagtggaagtccatggaagaatatttacaggcatggaagagtgagtttgaagtggggggcaaattctaaagagtaaagcctttaccaatggtaaactgtgccctttctatccatgccagcttgggaacccagttgagagtctgaaggagcaggacttagctttggacctgtgagatttcctctgtccccatcccaactgtgctcaggcccatcactttgcaggagcataattttatggcaagaggttcaccacatacctattgagctgcaagaggagtgatatcaatgtgcatatagttagggagagcaaagagtgctaatttagtaactgaagataagttacattgtatatgagatgtatttatatgcattttctacttctctctcctgcctcctgtatcactataaaccctagcagtcaagttccatgtcaggcctgttggatctttttcctgccatagagggagggacctgggagatggggagggattcagggatgacagtgttccagagtttgaactgggcataaagatatagaaccatccactggccaaggctgtcataggtaaatcctgcctggaggcaatttctagacagaacattctgtgagcttctaaatgatcctgaggtcggtatgcagatgctgacttaccagatctaatttgggaaaaagaagagggtaagaagttatatcttctgtggggattctggtggtaaggatgggcacagaagcaaaagagtgtttcctccttctccagaacatctggcttcattgcaagccactgtgggctactggagtagatggagagcagacagcatggcaccaactgaacactgtgcccactctccagacctgtccatgcaacccacagtagtggagtggccactccagggtcaggtagatatggcttccttcccagctctgccaattcccagctgaaaacattcttaaacttttccagtgtcctgtaaaatgggaaaaccagacctgtcccattgtatcctagtgagaattacatgatgtcatgccattaaagtacccagtaccaagcctggtacattataaacatccaagagcctaggtcttagcttcttcacctagcatgacacctctcccacccagcttactataccactgtgagatgataaaagcacacaagccctgtcaatgctaaaatatttatgaagctatagagaatatttttttaaattttcaacctgaatgtctgatttttttcttctgtatagagacagggtatcactatgctgcccagactggactcaaactcccataattctccaaccttagcctccagagtagctgggtgccaccatgcccagcttgtgtaagagcttttctgtcacgttctcagcattcctagatgcatgcatcaggacttcaattcatgcttcttcttgcctacaagtgggttctgttggtagctggaaagccaggctatggtggaggcaacagaaggaatacaggggtcccctttccaaacctccaagttatctgggttgggatactacaattttaagagtatcaaggaaggagctggagagaggaacttctggacactcagtatagctctagactctctctctctctctctctctctctctctctgtgtgtgtgtgtgtgtgtgtgtgtgtgtgtgtgtgtgtgtcagagaaagagagtgagattgattttttattttgaactgactaggtgccaccccttcattaccatgctgatttaaactgtcaagactgcagcctggcctgaccactgaggagcaaagacaataggaaaacagaaggcgactcaggatgcaaatgcctcattgttacagaacaataaacagattcacccttttgctaaatgtcaggttaatatcctcttggcaccagctgtgcctctcccctccttccctgccacagtgagtccaggctcctggaagtctgcccttcaccagccacctaggctcagcactgggcgtcgaggagagcaggtgtggctggcacagtaaatgcaaacacaaccagtccaaccgcaaagtggaatcagcctttgcatggagtgatatcctgggacagcctcaagctctgactttggggagctctgggctttgggctacagcttgggtagctgactaagccaggggatggcactaacacatgttctccgtgtacttactcacaagccaagaacaggtaggcaaggagggaggatgaccttcaaggccagttaccaacaggctccaaatgcatttcccatggatgcccactgggcccatccccattcctccctccaccaagtccctatccattctaacttctcatgatcgcttctttctgccttatctctgcattgacattgacactgttgttgctggggggctttgctgtgcttgcctctgctgccccaacaggtctccttgtcgccataccattctccacagtatctgcagagtctccccagttagatgatctggccaggtcactccttaactcagaatacttctgtagctccctctggcttttaatgtaaagccaaacccttagcaagccactgaggaatgagtttgaccccattcctctgaactcacatggtcctttgagtttaccctttgcccaacccttattatccaggatgggggttgactgttttggtttcttcccccccatttctaaggacaggaaccatgcctcttacctctgcacaccctgtgccttacatggggtatggaacaggaaatgtgctcagtagtgattggaagccattcattccttactcagacctctctacaaattgtccctgagtctaacccacaacttccctcactgcaaaaatccttcagattgctcctgacaggactgtcttcctcatctcatctgttttctctgtcctaatcactctctggagcttagctcaggttcccccacaagtctcaccaccatgaagcctctacactgttttgtcttctctaactgcatcccccacgtggaacttcataacggtaggctttgtaatagttactttacacctctgaacctcatctacaaggatggttcacaatagatttgccataaattttaaattatgatgcaatataaataaagcacatagcacagaatctggcacacagtaagtgctgaaaatagatttgtctgatggtgaggacgagcgtggtggtggtggtggtggtggtgacagtgataatgatgatgatatctctgttttatattgcaagacccagaatgtcaattccttctttgagggaaagggccactgcttatagtggtcttgacaaacttcaaaacatatggcccaatgcttatttctggtggaagctttactgaccatattaatgctattgataatattttcatgttattggtattaatcacgttaccagggaaagagcattggattcaaagtcaaatgcagactttcagtcctgtttttccactttgggcctcagcttccttagctataaataaatgagttttccagagttttccagaatgatctgtagtcctttctagcaatgataattacgtggttattagtgagactagtccacaccaaagtgagcctacactccatccatatgggtcatccctccccagtatacctgggccccaaaatgcaagcacaccatggggaaatggaagaaattgggacttatgtcatccaaccaacagaacgccagtcctcacttcaacacacaaatgttttctgttttaaaatctactccagcagcactacaattggcattccccctcctagcagtgggttagcagcagatgttacagcaaaatgatccagactgggggtgattattaacccttctgcacagcatacccatttttgcttctgggtccacacttgcacacctaagacaagttcacccgccatccctgtcatcaagagcttcaccaccttcttgtctagacaagcttgaatcccaagcagaagaggagactgagcaccatatctttgctgctgtttttgttgttattgttgttgttgttgtttgagatggagtctcgctctgtcacacccaggctggaatgcagtggtgcaatctcagctcactgcaacctctgcctcctgggttcaagcgattctcctacctcagcctcctaggtagctgagattacaggtgcccaccatcacatcctgctaatgttttatatttttagtagagatggggtttcaccatattagccaggctggtctcgaactcttgacctcaggtgatctgcctgcctcagcctctcaaagtgctaggattacaggtgtgagccacctcgcctgaccagtatcaaatcttatcaagtatcaaccacatcctcctataaggtgagaaaccagaccccactgtaaggtaggactgcccacaatggtgtaaagagccatctgggaaataaatagtaaatagcccactgcaaaaaaaaaaagtttcaagacagacaaacctggcttctctatgtatagtctgtgcgatcttaggtaagccacttaaatgctctctcagtttcctctactataaagtggggatttttatgtcaacacaaccccaggaaataggctttgagtataataatattcacaaagcacacaaataggcactctgaagaggtcagcccctccctttccaccctgaggaccttgtgggagtgcacacaacgtgacctcaaggtaaagtgggactctgctccactgtttatgacataactgggttgtcttgcacattttaaatatctgtctgtgtctcattttcttcatctaaaactattcatatccccaagatttgttgttgggaattaaacaaaacaatacatgcaaaacagtacttggcgcacagtaagcactcaataaatatgtaattgtcatcacccatgttatcattatcatttaatgatgctgaagaacaagtaagtgcttatcacttcctttaaatcttggcaccaaccacactaaaatctcaggcaggcaggtcaaactgcaagtcagagggccagtactgtcaagtcccaacgaggccacaggaccagttacccatccgcagattatccttggaaaatgtttaaagcatcatccactctgatgtcagcaggtgtgtgctcaggcagtgctagtgtgacatcctataaaagtcagaaaaaaggcctcaaagaagataacctgagccaagaacacaggcgtagcttaactaaaatgtttgtctactcagacaccttggcccctgtccgtggtcctgaaagagacaagtggacaaagactgacgggtggtcatgacttttctttttcccttttgcaaatagttgaagacctcttctgatgcaaatggtatcaacaaaagataacagaagaaaacatatatgggaggtcatgacttctgagacatttccaaggagaaaacagaaagactcttcgacatcaagttcaaataaacaaaattattgagaataaatatatatctatattttttgtttttgtttttgttttattttgtttttttaagatggagtcttgcactgtcacccaggctggagtgcagtggcatgatctcggctcactgcaagcttcacctcctcagttcatgccattctcctgcctcagcctcccgagtagctgggactacaggcgcctgccaccatgcccggctaattttttgtatttttagtatggacagggtttcaccatgttaaccaggatggtctcgatctcctgaccttgtgatccccctgcctcggcctcccaaagtgctggaattacaggtgtgagccactgcgcccggtcaatatatatctatatttttagtcattgggcttccccacctcttataccctgactctaaaatcatcaaaaaacccttcataatgcataccagaaataacacaaatcacttgtgtggtctttggctactgctatggtctgaatgttttgtcccctcaaaatccatatattgaaatcctgtcatccaatgtgatattaggaggcaaagcctttggaagctaactaggtcatgagaaggatctctcatgaatgagactactgtctttaaaaaagagattccagagggccctcttgtttcttctgccaggtgaggacacagtcagaggactgccatctatgaaccagaaagcaggccatcaccaggcatggcatcagttagcaccttgatcttggattgcccagttttcagaactgtaaaaagtgtttttgtgtcaaccacacagtctaggtatttttgttacagcagctcaaatgaactaaaacacctcccctctgttggtctggataataagaaattgaacaacacgaatgtcctatcctgaaaataatttaattcttctattccctcatttattgcaaagacatgacagaaaatatttagtaggagcaaggctctgagatttcaatcctaacctctgattccagtcctaaatccatcactaatcaggataagaccttgggcaaattgcttcacctctttgtccctcagtttattcatctataaaaatgataacaaaaataatacttagttcataaggttattataaaaattaaatgagataatgcacccgaatagcttaaaaagtgcttgccacattgtacaaccccagtaaggataaatgttaatattataattagttttattgttattattattgttgttgttccaaattagacgtaaccacatattggtttgcacaggtgccctttctttgtactgtttctaatatctaaccccttctatcctctgcctgagaaaactgtggacatatcacgtaagatctgaagaaagtttgttcactcacccacccacccactgagttcaccataaaaagaattcagaaatttcttacaatgggagatagtaaaaacataatggccacaattcccaaaaagctgcagagagcttatacaccctcagtccacatcacaacagagccactctccactcccttacccagccatgcttggggccactcctactcacttcctcatcattctgtcaattttagaggagcccacggggctcacacaagctgtgcagatcaccaaggttagtatctccattgccttgctccttggaagaatgttcaatattagttcagtgttcccagcccacaacctaaagcctccaggagtcaggatgaaatacaaacaatggcaatgacccctccttatctggaactcacaataatttcgtaaatactgctatgcaccttggttccttcaatcttcttaacatccctccaaagcaggcggttagtgatctcccgattatacagaaaggtagctgaggcctagagattgacatgacttgctaaaattcacacagctatcagtgaatggcaaaatcagaacagcccaggatggctcttcaggcagcaaagtttagtgggaaaagcagccagggagaactcaagttcaagggagaacttgaatcttaacacttattacctatatgacctcaataaagtcacttaacctgtgaggactcagtttcctcacatgtaaaatgaaaatagtattttccattcaggatgctggggcatgcaataatgtgggagagcactgagccaagtgtttggcacagagatgggattaaataggagggtcctattgttattattactatggttaggggagccccattccctctccaacgtacagagccacacggaatctaaactaaggaggccataaaacacactggctccagtctaagtccagtgtctttctccctgccccccatgtacctgccagccacatgcctgaacagcagagagagagctcaatcatcacatgtggcttatctagagaacttttaaatcccacgctggcctgacccaccccagctggcatactctcaggcctctgacactggcagcaggtctgagcatgaggaatacagtatctaatctgagcaataacttgcttatccttatatttaatttatacaaaagtgctttatgatatatggcatgatggcaaccatgggtcagtgaaacatatgaatttccattaaacatatccacttccataaacaaccattcctgttttgagtaggtagagccagtaaggatgaaatgatgctgaagaggaaggcagtggagggtattttataaatatcaatattcaaataccacttaagtcctcatatttacttaataaatatgacaatgggccaggcacagtggctcacacctgtaatcccagaactttggaaggccaaggcaggaagatcacttgagcccaggagttcaagaccagcatgggcctgtctctacaaaacctttaaaaaaaaaaaaaaaatcagctgggtatggtggtgcatgcctgtggttccagctgcttgggatgctgagatgtgaagatcccttgagtccgggaggtcgaggctgcagggagctatgattgcacctctatactccagcctgggcaacagagccagacctcatctctaatatatgtatatatatataaaataggtaacctgtcccctgtcccaaattgccctggggagcactgcaaagccttaaagaaatacattggggattatctgcttgtttggttacccaagctgctacttcctttttgtctataattaatgaaattagaccatgcacatagatgagatccactcaagtctacaaatattgacagcactagatatacattttgaggccatgaaaatgcaatgaggaacaagacacaacccctgttgttacgagggcacagcccattgtgggagacagattacatagcatttacagtacgataggctgagtacgcaggggtaagggaacacagaggaggaacatgtttcctgaatttggggcccaaagctgagacctaaagcgtgcacaggagttggccaggggatgagagggaaaaaaaggagagagagttgctctgagttaaggaaacatttgagcaaaaaatccatttgtaaacagagcttggggacctcagtgctgccactgagtgacaattcataaatgcagcaactctcagccacccacccaacattattctgtgcttgatcaagagctgaagcagcctccagctgctgccaccttctgccagcagtgttagttccatgagggctgttctgcccatggatcattgatgatctgttgtcccctgcatgcacagaccagaaaccccacctccccacctgctgctgttaccctagttgacctcctgcctcactgggtggcagaatggacagccctgccatctgcttccctccccagagcaccaggcatggaacactggggatttatggggtcaccaggcagagctaggagggttttgcagtggtagggaactagcagtacacttgaacacatccatgggatcacagcaaggaggccaaatgagataggatagggattcaaaggagaaaaacagaaccacagaagtacacagctctcagatgaaagccacttaatcagcctcatcccattttccaaaattcagacaaatgcagagaaacactgggcttatttagcagtatctatactctaacacacacatacatgcacctgtgtgttaatctaattagacagcttttctagttctaaaggtgaaatgcacgaagagcaagttcttaggttattttctctttaagcaagggggactcttacatccaacacatgcaacagctatttagtaaaacaaacacatgttttcattctgcttcctgcttggagctccagaatggcctcatctggtcaaggaaggtctcggttctgccagcccattcgagaaggcaaatagcaatggtatagatggcatagagcaggatgtgagtcctataccttggattgccctggacagagggcctattgtctcctctatttttggaccaaatgggtgagaaacagcttatatcaagaatggcctggcacatgcctgtaagtccagtactttgggaggattgaacccaggagtttgagaccagcctgtgcaacatagagagacccatgtctaccaaaaaaaaaaaaaagaaaaaagaaagaaagagagaaagaaagaaagaaagaaaagaaaagaaaagaaaagaaagagaagaaaagaaaagagaagaaaagaaaagaaaaggaaaaagaatggcctggcaaataacccaaagtcctctcaaagctacattactataaacgagtcgcatgcttataattcaaaaataacatttgtgcctaaattcaaactaacacattttaatggaatggcaacatttttaggcctcaactcattctgggctcaaaataataactagaacttcatagcatttgcttgtggaacccatattccttgagcagtatctccctaggcaacagctccagtatatcctgcattagaggatatttcagatgagatgcacttgtgttgcctcagactactacggagtgactccgcagctgctgaagtgttgcctaattgaggatctactttagaaacgatgtgagtgtgatgggtaattggcacgttttcctgcttctgagagtaagctgtgcgctccttgggaggtgaaacccacttccttgtctcaccatggcttgaatgacataataggatttcagtatatgcaattgttgagtgaataaatgaataaagaaacatattagctgaattattgaaacaataagatcaagtaagcccacatagatttgttcaccttcttcacatgccccctgcctgccccaaccacacctcctttcctttgccttgtttgattttccaccaggctgcttattatactatcggacatgtaagcactttacttggaaatgtgtttattttcacatgctgtgtaaagtccaaagggcatggatttttatctcattcgctcaccgctctactcccaccacctagaactggtccctagcaagagttcactgagcattttgtgggggagttcattgtaagactctttaagaatcactctatctctaaacagaaatgatggaagatgtttttgttctgtgtatcaagggtctttatatatgtaaattaatcaaaaattaaggtgtatttgagggcgcttggtcttaaaaatgtaaccattccaccttgcactgttttcttacaaaaatctttgtaatttggccccaacataccatttgagctttattacatcatcttcttcattaccacaatcatcactaccatcactgttatcattcacaattacagaaaacatttaccaactgcctgctgagtacaaggcattttgaaaataggtgtttgggggccagaaaatgaatgggatgctgaggtctctgttctcaaactgcccatctaatgcaagcgttgagacatatttacacatgaaacatacactcagtgtcaaacaacgggttgaaccagttctgtctgacagaaatataataatgagagctatatagctaatttaaatttgtctattactcatattaaaaaatgaaaaataaacaagtaaagttaattttgatactattttgcataacccaatatatgtaatatattataatttcaacatgtatccaatatttttaaagttttattaatgagattatttttcttacttagttttggaacatgtatgacacagcacatctcaattcaggctagccatattcaagtgtctaacagccatatgtggctactggccacatattggaccctcagggttagactaaaggattttcagagtacagaggaggggacacatctcagcaggcacaggagtgtggagaaggtcccatgagaaaagcctctccccttccctccttttcctgctctttccttccccatcttcctcctcctcccgtcctcatccttatggaagcacaagcggtatagttgcaggggtaaataggtgtcccaagatgaaaacaaagggaaaccttgggcttacccactgagagtccctgttccacactgcctcttcttctctttctcctaggcacagccaaggaaggttaaatcccattccatcactaatgagagatctgcccacaagcactaaaataagattcctctgatcttaaaagaaaagtgtttttggactttaggcaaccctggggacttagagttgttctcaaccctagcatccatcagactcacctagagaaaattttaaaagtaaagatgccacaagtatacactcccagattctgatttaattggtctagagtgaggcctagggatgtttgcaccttttttaaaggctcctaggtgattctaatgtgtaactagacctgagaactgctgggctggggtgcagaaattgcagagtggaggagaggaaagagtggccagttggctatgatgccattaaccacagcactcagcatcactttatgtaccctttctcgttggatccatatgataaccctgtgtgacaggtaccactaacctcattttgcaagtgagaaaaccaaggctctaggaggttaagcaacttttccagggtcacacagttagcaactgggaaaggaagaaactcaagcccggtcaggtctgactccaagacccatgctcctcacttcatatcaccccttgtccctcctcttcatcaaccttgccctccatttccactccaccaatcttggttcaaggtgagaaactgggatgggaatgagaggatgaagaaaactaggtaagatgcagggacaggttgggaaaaaatagtaatgcatacagcagatgcagggggaagttgggaaaaaaatagtaatggacacagcagcaagggagaaacctccttcatagatggccagcatctcccagatatttttttaagtgctagatagattaagtgttgaaaggacacatgcaggggagggtgctgatattgactacgagacttgtttggcatcatgacaaggaagaagtgatgagaaaaggtgtcccagaaaattaaccattacctagcttccacagaggatcctgccctaaccaacagataggctagaaagaaggctacagaacagaagacaaagaataaaagagctgtacacaaagatatgttctttttctgaggtttcatacactgtgaaatttccaagtagtgaaaaattaactcaatgcttaaaaaaaaaaaagaagatgaatgcaaagaaagaaaaaaaaaagaaaaatctggcaatgttggaagagaaatcagtcttgcctgacagtatttaaattgaatgtctgtgagcatggcccacaatttttagtgaaagtagaagctattaaaaagtcgatgcacaagattaaaatttagaatgctattttaataataccaaattctactcaatttcaaatggctgtcatttttaagctccaccaatttgataacacttgactgatggcattgggagctgagtgatgggaagattgaattcggcaggtccagctcagctgacacagccagagagatgaatactcatcctcaaagaactaagcagaccaggctgatggacctcttagaatctgttttcccatctgtaaaatgggactaacaatatctgccctactgaaaggaacaagtgtgatggagggtgaatgaaccattgtcaaaagcattgtgaaggtcaagaatgcattgtgctcccgctgtgggtagagcctgtgctaggtcacaggtcacctctttctggaagcttcccacatctcccaattctaacttagagaatcaacaagtagttggactagtcagtgctgggatgagaacatgctcaggatgttccagaactcggagacaagtcatctgtcacgtcattagatccaccaccttgtaggactgggagtttgctctgtgtacctagcactgtgcctggtatacagtgagtggatcctcaataagtatttgtagttccctcattcaacaggatcttgtccctaatgttttgactttagatgggaagacaaatatttaccaagcataatataagtactgatgcagagaccatcagagcattacagaggaagaagaaacactaggccgggcatggtggctcatgcctgtaatcccagcactttgagaggcccaatgccaaggctaaggcaggcgggtcatttgaggtcgagttccagacctgcatgggcaacatagtgaaaccccttctctactaaaaaatacaaaaattagctgggtgtggtgctgcacacctgaaatcccagctactcgggaggttgaggcaggagactcgcttgagcccgagaggcggaggttgtagtgagccaagattgcaccactgcactccagcctgggtgacagagtgagactctgtgtcaaaaaaagaaaagaaacagaaaaatcatttcaactggatattgaaaaatcatttattataatcactgtggtcatgtttaatgctgttgacaaatatttcctgctcttcacatcctaggcatgcagcaggattacattaccctgcaccctctgaagttaggctaagccatgggtcctacactggccaatgaaacatcagcagaagtggcatatgtcccattttggcagaaactttaggagctgtgcagttctccatgttttcttcctgcagtatggcaaatggaaggacatgttaaaatgaagaatcttgggggaaaatggctccagaagcaggggtttcagtacaacctatacagaacatgaaggacaagcaagaaatacacctttgttgcagaatccgactgagatttgggggccatttgttattggcgcctctctttactaatacaatcatgtcaggaggagctccagcaaagtatctgtaagggaaggggtgagtgagcctgaaggctcttgagagtgaaaaggaaacaggactcaagcctctctttggtcacagactcagctaccttctttcggagatttcctccacagggatacactgaaaatgccactcaggtttcagaagcctctgagtgaggagccccagactcctgccttttatatacccatctcccgccctcatgccttctggaaatggtgctaagtatagctgggttggatccctggctcaattactacatcacaaccagagactgaggaataaacatgccagggtggggctttttctctttgcccgggatggctctgcctccatctctctcagctctcagcgaaaatcctcccctgcagccagaggcccttacagaccctaagcctctgctcctgctcttctccagcaggtgctgcctccccttctcatctctgcatctgtctgtcctgcagagctcagttcacaccccatctcctccagggaggaccactacagactccagcctattctgtgctcatcctacgagctttgaacccatctgacactcaaccatgccctgtcatcagaatagtgctagcttgttcatctgggcaggttggatctcttcaaaggagggaggaacccctaaatcttgatgatgtcatttgtgaaatgaggcccctgctctgaccactcagaactgccattgggcatcaggtgagttgtcagatctaaagcccctgtcttggtgccaaatacctaacaggtgctcaagaaatgtaagactcttctcaattccctttgtctacaagacagtttgacaaagtgggaccagctcttctcctcccacagtaagcccagatgcgtctctagagatgtgtctcatgcatgtattctcaatgggggcaaagtctcctccaggaaggcagacattgaaaagtgaaaaaacaacctttatgtataaacacagatacatacagagtacacacacagatatacagtgtatctgtggtattaaaatctcatggggagggggtaaggaagtgtttttttaatgcttagaaaagctccataggtatgcaataaaggaaaaaaaaaaggcaggctcttccatgcccatctcagctgagcctcttatcacttgtctcttatatttcctctcttgtgtctcttccaaatcaataaagtgatattttagaaaattctgccaaacccacatttctccctcctccaccgccttcccagcctctctgctcctgtgctcatctaatctgctgcctttcctgggatgtcagccttgcaattggctacagggaaagcaggcactggagagctgagagactccagtcttggttttccagacatagcagatgtgactgtgtttgtatctacccccagcaacaccatggggaagcagagctaggcactcctgcctcaccccacctccccaccacccagcttgactcagaatggtgcctcaagtcaaagacctgcctgcaactcccaagagaactaaatgtttccctccactaggggagggttactggtgggtttgggcttaggctggtttgttggaaggtggctgacactgcagtttggctcacccaaggtggagtccaaccttgcctgtcctcgaagatggaaagctgaataatcaccttccagcctcccttgcagctataggtggccacgccacatattctgcaggggaagatgtctgataaaaagcaggagggaacagcttaacctgatattgcccttcccccttttctttctaccttgaaatggacccaaagtctgaagctctccatctctcttgcagccatgagtgaaaagccaagggaatcctgacatcctacagacactatcttgacatgatgtagcagcagcactagtgccagaaacccctacatctagacttctacttgtaggaaaaactgcttttctctctgttacatgaagcccaaggaatcctaactaacacagaagtcaagagtgacaggcacagacacatgaaaaaatgctcatcatcactggccatcagagaaatgcaaatcaaaaccacaatgagataccatctcacaccagttagaatggtgatcattcaaaagtcaggaaacaacaggtgctggagaggatgtggagaaataggaacacttttacactgttggtgggactgtaaactagttcaaccattgtggaagacagtgtggcaattcttcaagcatctagaactagaaataccatttgacccagccatcccattactgtatatatacccaaaggattataaattatgctgctattaagacacatgcacatgtatgtttattgtggcactaatcacaatagcacggacttggaaccaacccaaacgtccatcaatgatagactggattaagaaaatgtgcacatatacaccatggaacactatgcagccataaaaaaaggatgagttcatgtcctttgtagggacatggatgaagctggaaaccgtcattctcagcaaactatcgcaaggacaaaaaccaaacactgcatgttctcactcataggtgggaattgaacaatgagaacacttggacacaggaaagggaacatcacacactggggcctgtcgtggggtcggggggagggggcagggatagcattaggagatatacctaatgtaaatgatgagttaatgggtgcagcacaccaacacggcacatgtatacatatgtaacaaacctgcatgttgtgcacatgtaccctagaacttaaagtataatttaaaaaatgccaaaaaaaaaaaaaagagtgacaggcataatccttacccatctgacttccctggagtctctttataaacacatctgtactacaaaacagaatgactagtgcttctcaatgtccagagtgcagggagactcagagatgctctgccatgctttaggtcccagggtcatggcctctctgcagggggttaagcacatgggctttgcactcaaattgacctggattctagtcctaactcctccacaaaagctgtgtgatcttagacacctcaccgttctgtatgtccgttgttttcactgtagaatgaagttgacaacagcacttatctcatagaattgttgcaaagattaaatgagatatatcacacactaatctcagtgcctggcacatactgtcttctcaatacgtgttagctgtcaagataattttccactttccctttctgggtctaagtccttctatgagcttgtctgtctcatttcccaattatttctcagtgttttctcatttccttatctctgtagctctttccttctcctttctctgtttctccatctctctgcatgtgtctccatttttgtctggctttttctccctcctccctcattcccattcaggtttacagtggagaaacacagcaatttgcctaattttccctctcccaggtcaagagaaagcccttcccaggctctcagtcacagttccttagacgtgggtcccccagatccccttgtgttctgaaatgcctgtgatgggaaggggaggggatggtgatgtggtctcctgccaggaaaagttgctgaaggttggggctggtgaagggggtagtgagagaggggcctgctgccctgcctcaggaatcacgtccacttcatgactggctttagcagctgagtctaaaagctttggaaggaaacgctgggtccaccactggctccattcctgcctccctttctggcctaccccaggattccttggcagaacttggaatttggtatagtcagggacaaactcttctctcagatgcttactgtcccaaatggaaagcaagacctaagtgcataatcctaacccaccatggacagacccctctggctccacagcacccaaaagacccctctggtgaggggagcaagtcaccaataataacccacaacacttgccctgcactgatgctgcttcaaaggcctttcctgtgccaacctactgacatccttgcagctgcaccaaggaacagactcctctttccccattttacaaatgtcatggcacatgggggctaagtgatatgttcaaggtcacacagttataaatagcaaagacatgttccaatctaagcaataacaacagcaataataacagcaacagcaaaataatattaagataattttaatgataaaaacacaatgtagcatttattatatgccaggcacatgcaagggctttgcatctattagctcattaaatctgacgcctaccctgtgagataactactatcattgtccccattttacaggtggaagggaaggtcaagggaaattcagtcatttgcccaaggcctcgataccataagagtgtggattcagggatgtgcatgctgcagtggccaaggcccacaatcttatgggacagctgaccacccaacccccagccagattcctacaagccccaggagtaaacactcccatgaagaatcagctcaagctcacctccaggctgagacaaagggtcaccaaggactggccaccacacgaatgcttctccttggtcttacaaaacatgaaaggtgctattatcagaagccatgcctgcttgcaaactacagaggtgacacgaggtaaattcatttccttcctgtcaagagaaactcaacaagggtataatcagaagctaatgtgtgtactgtgattgggcccatcacggggtggcacataattgaacaagttctccatgcctggaggagcagagccgagccccatcactgggaagtgtcactcatctggccagcacacattggtttttaataacattatggaaataatgctgcagggctgtggaaaggacagaagcttgaggggcagggcctcatcaggtctccgagagctttgaccttgagaaagaaccttctggccccatccagaatagccactttcctcagggatctctcctgtaggctttgtggatttatgtctcctgggcttaaggaacagggcttggtgtggctgaaccttcttgctgaatggatcccaggggaccccaggtgagcattgaggccgggttctcaagagactgaagggggtcggggggttaccagagagaggacaggccctttgcttccccagtaactgttgacaatggtaatacctccatggcccctactatgaatcagataattttctgaggactttatgtatattaactcatttaaactgaaaaacaatccatgtgataggtattgccattgtcctgattgtatagataaagaaattgaggcacagagaggtgaatttatctaagatcacacaggtgggaagttgtgtttgagcccgggcagtccatcatcctaaccatactccctactgcctcaatgagctgacacagcccagccctgataaagggggtggcagaggggagggggatgaggtgccttcctggctgttggcattcatttcattcacatttttatcaggcacccctttcaaccagatactgctgtaggcactgaggatacagtggagtataaatagataagagttatattctagcgaggagacacaaatcccatataaatgtacaaataagacaatttcagagaatgccaaatacaatcaagaaaataaaaccaagaggtcatagtgtccgtggcaggaaaaggtaagtaagttattttagagaggaggaaaaggtaactttaagaaccagagacaactgtttaggagaaggcctagccaagactgaataattcatgtgttaagaggttttcaatcacctaccaaatacaggaaggaaccagtcattgaggctattgagaagtcaagaagttagagacctatgaagacaaaggcagcctgggctctgctccacctgcccactcatgggcctaggcatcagaagctccgccatcttgcactgcaaccctggaagccacagtctcttcagtgccatcagggaagacagcaactgcaccaccacacacaggcatcccctgccccagcccagaagtgatgcacatcccttagtgcctcatgtcctgcctaacagtggatgctggaaatttacaggagcaactggaatattcataagcctaactgcctcggccaccagcccacaagggacactaatggagacagcagagttgcgtgagggctcacgagctaagaggtggaacccagccaggctgagtagaaagtaagccatcgacaagcagggagttaataggtttttccaaatgaacggtccttaatttcaattcattgagaggtgagggatcaggtgaaggaagcaaggtgaaaaggaggattaatccatccatcaaggaccttgggtactgaaaacatgaaaagatgaatgcatttgtgagacatactgattcactaccatgagaaataattatcttgaagcttatttggtcccagaatcaatctttatttaaccgtacttatttttggtggctcatcctgcttgcctctcttggaaactcaagaaatgctttctctatttttttttttgggtaaattccaaagacttgcatatttcatatttttcaacaggatgatctttgtgtagactgactgtcttccctcttcactagtcctctctatcattggacctcacccgtagtaatcactcactccacaatcatcttctcttgtttcctgcatcactcatcactaccttaaagtattatttattgatttattatttttttataatctgactcttctattgtaatataaggtgggtaaagacggagacctttcctgtctccgttggccacatccccaacaccacaccaatcaagcaacagactaaggacacagctaaataaatgaacaaaaagataataataacaatcatgtgttagtcttcataacaatcttcatttattctttttgattattcccatgttacaaatgaagaaatggaggcacagagaataattaagtaacttgctcaaggttatacagatattgtaaaacagccaggatttgaaaccagagagtttggctagaggttccatgctttgttggtataaatatttaagaaatatttgttgattgaatgaataataaataaatgaatggcttccttgtgtttcctgccttctttaccagggttatttgccttcaactttcactggaccctctatgtatcaggcatggtcttaaattctcttcacacattattcagttgagggtagtcccatctaccatatctccatagaatcggtcccaagcctggtacttagaactgccctgcattgtcaggctccccctttgccaggtggtgcctccctaatctgaaatcatggactgagtaccttcaaaagaaaaattaaaccaaagatcaggaggagatgcttctgacttagtgagtctagaagaccctggcctcccttgcccactctgcccagaaactgaatcccagagagatgaagttatgggtttcatacctgtgtctgcccatcaacccaagggggacaaatgccaacatagaatgacagagagggaaggaagaaagtgtttttcctaattaattggctctaaaagtggagaggaaccaagttgggttattatagaagcatcagcgtccgacacaggtcttcaactgccatgcaaataccccctactctgcaccatgcagttcccatggtttactctgttgtgatgtaactgtgcatgtttctacctgaacccattgaacacggctttgtgcttgaaccttgaacaatgcctgggacacagttggtgctcaataaataatgatgggataaatgaatgagggatccccattctcctacctaccttggccttgtcatcatctctcacttttgcgactgccagataacacctagctctatccccttgagccatccaagtctcagacacattcatatactgactgaccttgaatacatactcccttcctgaaagagatgcttcccaggaccctgcatcatggaaaataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcg

SEQ ID NO: 2530 - DNA, 768220 bp, Homo sapiens; identical to SEQ ID NO: 2529

SEQ ID NO: 2531 - DNA, 752944 bp, Homo sapiens; identical to SEQ ID NO: 2526

SEQ ID NO: 2532 - DNA, 135801 bp, Homo sapiens
cttacagaaattgacctttatttgttgtactaaagcctgtttaacttttgatacaaagtaacattttagtacagaaaatcccagtctgtcagctcagtacctgtctgtgcacactgtaccatctcagtcccactctgcctgtaacttagaaaacagcccctacccccagagggtctgcgagttaataccttgagaatagtctacagtttttcatagtttgtctgagctagaaaacttgtacctgtaaaacaaaggacagcattgaggactgaaacttgtctcttttttgaacaactgtgcaagaaaatatatccctttttaaaaaacatcagttatggctaaactacaatctagtgtctagaattacaaagaataaaatgaaatcaaagatttctcgctagtaaaatgaaatgttaggaacagtattaaaatataggtcctaccccaacgacacttacacagagcccagtacagtacctattattaacaggacgcatagcttaaggaggaaccacatcaaatcttcagccagacatatctagcctcagaagtgcaaaaaaaaaaaaagcccccaaacgaagacacccacactgagtagggtgcatgccgtgagtgctgtaatcaagattaaaaagacctcagtttttctttttagactgttgatagtgacaataaccattatgcttcccctaaaagctctcaattcaatgtctgaaacatgaatgttttcatatcaaaaagaactgatgtacctgccaccctctaaaaagtttaagaattaccctgcaaacattgcactgatgaaggctgtcacgacttacagagcctaaggaggacccaatggcaggcatcagcacagctgaacaccacctggaccccactgcagccctgcccacgcagctctcacggagcagacacagtcctcaagtaataagcacagatggaggagaaacgagaggctgtggaaggcaggagagaaaggccgagagacgagtttgtaagaatgccaaagtcaccttccccattgtgggaggaaaatgccaaaggcactggttctgctgccacaggcagtctgagcacctggagttgtgacgtccttccaggagaggtgccaccaaggagcaggaggtttgtcaaagctctggtcccaccaacaagaacctcccaaagcaaagcagcccccattgaggttccaaggtcgttttgctgaagacgggaacgaaaccaacaccaaagcgacagggggttgacagaggggacaggggctgggcaccggcaacatggagccgttcaagtaaacataaaccaccaaatacttagaaaaggcttgtaaacgagtgatccgaaaggttctctttgcagcatctctgatcagctggctaaagaaaggtgggtgctgaacccgtctttagtgttatctgttttgtgttaaagcacacgtgtgacacgggcagagtgtgtgggcctgggcctggatcgcacgcagccgtggccctctgtctacaaaggaggtgcttctgggtcctggttccggatccttcccccgcatgttcatagacggacagacttctactttcagtcgctagaaaagagctgagtctggtgtcccctcaggcggccagctgcagtcatccacagcacagcattctcctagagcgggcaggctggaatccacaggactttattttgttcttgattgaccattgccaagatctgagtgcaaatgcttgacagggctcctccctggatgacccctgcaaaagagccccccagacacgtcattcagctcagagtaagaccccaggtttgaggcaaggcagtacagcttgcactctttctactgtgtggctgtctgctttgtgctccttggcactctgctccatccccacctgactctccttcaccagcaagaaactgggaaagaaaattgcccctcttgagttgatcactcatatgtaaactgcccaccccactgcagttaacaccctgggttgggtttgcaatggttgggggaatcccagggcatcagaaggaagtttggaggacatgtggcggtggtctaatcattagcaggattctgcaggaaacgacaagtttaaggagccagatagctcatggccaagaggagagtcacagaaagatgatggcgccaacttgggccagccctgtactataggagtttgacaaaggggtctatagacaccaggccaggggtactccagtgtgctccacataacagcacctggacacaaaccaagcccctactgcaacaaggcatgctcagaaattgacagtgagtgtctagaaactgctatggaaacaggacgtcgtaattttatgtctgttgaatctaacaagaaaaaaatagagcttaccttttgcaagacttagagttttaaattttcatctctctaggaattgtcagtgtatttggctaaataccagtctgtgaggaattggaaatgaaagttcacacacacacccacacacacacacacacagaggcatgcacacctgcacatacctacacacacatgggcaccaagcccaggtccctggactagatcataacactctccacaatgcagttagaatccctgtcccatcctctgtgactgcaaatgctaatgccctgcaaatgacagactttcccaaagaggctgaaggccagaaggtaaaatagaaccaaacttcactgagtttgtttcactttgaagaccagagatggtaaggggacagcattgtttttttttgttttgttttttgtttttttttttttggaggggggtttgccaaatcccgctgcaaaacgggactgccctggagggtgctagggacagatgggcccctagcctccgctgcccacactgctggcacactgggggctgctccagtccccgccctgcctggggacactgtggctgcactaaactgcacctgtgctatgagacagacccaccactgcacgtgtgaaaatgagcaggcaagccaggcaggacctgaggccaagatcggtgagcttaacattcaacctgtaagaatcctgacgttggccagggactgcaatctgaacacctgacttgtcaggaacgtgctcatgacagcacttgggagcatgtagaaagtgcgggcttctccacggctaagaaaacagccttaggaagcctctgcttccttccctgctgcctgctccccactccaggcccacgcacacctacctgtgaagtacctgctgtactcctgctcaagcttctgcgccgcctcaaactgctctttggaatgcctctgagtcaccttgtccctcaggtagatggggtctctctgctccctgtggggacagccagacaccaggctgagcactgagcctcctccaggccctctttccttcctctgtccaggctaacaggggccccatcaaggcaggggtaggctgtggagggaggccccatgtgctccccacataaagcacagcaacagcctgtaggctgtcgggggagctctgggcagatgggggaaggagggccccccagcacacacacttggaacagatgcaccagcagcccctagcgcaggtcccagaagctcagcagcacagaaaggcaaaatggagcagggccttggtgagcccttggcccaaccagcacaggagccgaagctcagcgaaggcaacggctcctgagtcatgagccagctcggggctgagtgggactgtgcccaggccactggctcccctgctcctaagcagcacgtagcgaggaaagggggctggggcaggagaggggagctgtgcagaccaagctggccatgcccaaaaaacagtggcagcacccaaatggcggaggggcgcgaggaaggggctgcgcttggctgacaccacctctgagtaggggacagggccgacagggaagggtcattttctacacgtactgcctatttcaagacccataggcccatctctcattcctcaaccccccaccccaacacaccctgctccctacttgggctcccagccccacctgtgacaaggccccagcggagcccagggggccagttacctacttgatgtgcttggcgctcttgtagtggatgaagatgacaatggggtagatgtgcatgtggtggagccgctcaatagcgtgcggagcaatgtccaggaggcagtgtcggttctggggtggggggtgcagagtgagccctggcgggcagtgaggggcagccagccccctgtcctgccaccagcaggacccacctcacctcacagggctctacccacaaacaaggcagtaaagccacacagtacaccgtggggaaaccatacccacgaaactcccaacaaaccccacttgctgtgaggaaggccaaggctgggagccagggcttagggggctaggggtgctggccagcccaactccaaacttcctttcccgcctttgcccagatacagggaccttctgaaagccctgccccaccctggcctctgaagccttatttttgccagactgagcgaatgaagagccagagtctggtgagcctttgtgtggctgagactgaaatatgtctgtcatgtctgtcgtcccaggcatccaggtggagtgcaggcccgtgcactcccgacccccagatgctccactggggcattcccccaagtagagtttgcccactttcagcagtgagaagccaacaccttcatctaacagagaagggaagcaaagcccagcgagcgagctgagcagcctggagaaatggagcccaaggagcggctgtgtccttggactccgagtgtttgccccaccagcactccccacagacgtccccgccctcgtgctgcctaggatgttcgaaggcaccgagagtcatagcccttttaggggcagggaccctgagggaaggcacgttcctgtccccagaaggtgcatgtgaaattgttcggcacatgcatttggggaccccgttccggaatgccctgcgagaggcctttccgcagagctcaatactctcatcagagatgagaccccccgcacctgccagagaggaagatggggcggcacatacacaggggaactcctccatccccaccaagggatgtgcttgcagaaacacacagcagccatgagggcaagcccaggcacaggtgaactcagactaacacaacacggtgggctcactgaaggtctgagccgctggggcagaggatcacggaccaggggcctagacctgtgcacaggaggtctaatactggatgcctaatcctcagactgaagccctgggtaccttttctgtgatctcctttattgacgccacagtggtcacatcgaaatggccgcttctccgcttatagtcgacaaacaggcaatctttgacaccccgctcaatggcctgctgggaggccttcatcacctctgcaatgcacagacacaggaatcagggagccccaggccctgctgagccccagcagagggagcaggggaagaacactgctcagcagctgtcagtaacccagtcctgccatgcatgaatctgacccatgtcagcaggcttctggaacactgtgaaatctgccccccggtactgccacccactgtgcacagctgggcaggcaggtggacagggacatagagacaaagagcccagtaggcacagagggtgccccgtgccccttaccaaggggacatctgcagaacttgccaggagcctcattcaccagcatctccttcaccacgtccagcaaaggccccagaatcaggacaggcctcagagcggtgcagtccaccttctggacccgctgataggccaggctcaccgaatctgagggagagagagcagcagcgtcacggacccagcttggagtggaggacctgagtggggctggggaaccccgctccctgacctcgcccactctggtttgcctgggactcccccagcttcagcactgaaaatctcgtgtcccaggcacaaccgggcatcgtcacccctggagtccagcatgagcaccccccatgccctctgtgaacaccagaggcagctggtctcaaccactcatcccagagcttccttctgctctgatttttcctcgtgggtcgacgcctgcttcccctgccccatctccattctcctctgctctctggcaaggcagcctctggggtttggcaggtaaagctcccactccccaggaaggtgtggtcagtgtaacccagacctgcccagtgacaggtgaggcctccccaatctgcacggctagaacaggtgagtgctgtgagccagctctggccatgcagttgaggataacccttaagaaatggcagaggcacaagatggaagggacctgggtcctggatgatcctcagaacgcaatgcctctcccacatcaaccacagctcagacttgtacatgacagagaaataaactgcccattatgcttaagccactgttatttggtttcagttaaagcagtcaaaccaatatcctagttgatacatgcagtaaacctccccttgcaccaaatgaataaagtccttgcagggagacacagtctaaaacccagcaagatcttcctggcgtctccctggtataagtcactgtgctggaatctcagaaacataataaagaatagaacacagagttcctgccattaaaaagcacacactttaactagagtcacaacagagcaacacatgaacagcaagagagcacgcaagagctgcctggcaattccaggagcggcgggcttcagtagacactgtggctggatgacagggtgaaaagaccacttgggcaggcccaggagggaagtgggatgagagtctccagaaagagcagggcaagaggatgagtatggagatgatggggagggcagagcacaagatgactgcaggcttgggaggaagggtccatgagaggcttggcctggagggatctgtacgcatatgcagaacaaggagtgactgcagagcaggcacagggaccaggaggcagaaggctcaggagaacacaagcacagtgccagctgcagcagcaggctccatgaagagcaacctgtgggcaaactcagggagtaagtaaagtctctcctctcctcttgccctgtccctgtgtgtgtgttttttagaagtgatcactgctgggcatggtggctcacgtctgtaatcccagcactttgggaggctgaggcaggtggatcgcttgaggtcaagagtttgagaccagcctggccaataaggcaagaccccttctctactaaaaatacaaaaattagccgggtgtgctggcgcacacctgtaatcccagctactcaggaagctgaagcacaacaatcacttgaacccaggaggcggaggttgcagtgagccgagactgcaccactgtactccagcctgggcaacagagcaagactagatctcaataaaaataaataaaataataaaactgatcattatccacatacatccacacagtcttttacacagcacttcctaacctggtgaccagcagctctgttgtttaaaactggaggagggtttggtggtcacattcaccaccttggaaccccatgtggtcccgagtgaaggctctgaggaggagtcacggggcaaagaacttcctccgagaggagtttacataaacaaatcctctctgtaacaaatctgaacctcacggataaggccagcactcctctctgataccccttccccaacctcagtccccactgggctccttgaaggtaaccactattatgagctggaagtgtatcctagttcttcttataaactgatttttatatgctaaagaaaacctagaatatatattgtttaagtgtgtctgtggatactttataactcgctccttgtccggggctgtgtttctgggaggcatccctggtgattcgtcgtgggccgctctgctccttttgggcatcccattaacacttattctggatcgacttatccacttccctgctgatggacactacgtcaccattccctccatttactagtataagaatcatattctcaaattatggcacagttgctatagggtggaattcaatatagtgcttaaaagaatggtttggaagaatattactgagatgggaagatgctaacaatatgatagtggaaatacctggatgaaaacagtgtaatgcagtgtaatcccagctttgttgtattaagtaaaaaactggtaagaaatacattaaaatgttaatggttaaaaaaaaccatattctcccttaatgattactaacattccacactatggggtaccaatttaggagattctttttcctccctgacaatcttctttgtcagatgtcctcacaattacagaattgtaagactagacagcatcttatgagtcactgactccaactggagaagaaaaacagcctatccaaggtcacagctaatcagggcagagcaaaggcatggtcctgggggttccaaccttagaccatacggcaatggctttctttaaaaggtgctgtggactgaactatgtcccctcgacatttatatgttgaagccctaagccccagtgtgactacctttggagacggagtcttcaggaggtaagttaaatgaggtcagaagagcaaggccctaatctgatagaactgcggctttttaagaggaagagacaccagagatctctctgtctccaacatgtgaggacacagcaaggaggcagctgcgtacaaggcaggatgacagccctcaccagaaccaaccacactggcacccagatctcggatttccaacctcaagaactgtgagaaaatgaattcttgttatttaagtcacctagtctgtggtattggttttttggtttgtttttgtttttgagatatgctcttgctttgttgccaggctgaagtggagtggcacaatcatagctcatcgcagcactgtactcctgggcttaggtgatcctccagcctcagcctcctgagtagccgggactacaggcacacgccaccacacttgattagttttttaaagtttttgtagagatgggagtcttgccatgttgcccaggctggtctcaaactcctggcctcaagcgatcctcttgcctcagcttcccaaagtgctgggattacaggtgtgagctaccgtgcctggcctgtggtatttggttacagcagccctagcagactaacataagaggaaaaccagtcctccatatattcctgagacactcccgcacaagcccctaaaagagcaagcataaagacatgcagtgtcctctgggtggtggagagttgagtccacttagaccattgcaggtgggtgcacaatcagcagggtggggggtaccagggatgctatgcagcagttggaagcaataaactaaagcaggaattcaaaacccactgtgcattagaattagctggggtaacttttaaactactacacagggattaccactcccaggtataatggaacagcttgcagcatcccttggagaacacctagaaaatctgggtaaaaaatgagaaatatctttttgaaggcatcgtagagtggcagagacaagacagaatttgagatgccaagatcctggagagaaggaaactggagtattagaagctgacattctgcaggcctttcccccttcagagcaactggagacttctaaagtgagagtgaggggcagagaacccaggcagagggccgccgctgaggggctgagaacccaggcacggggccgccgctgaggggctgagaacccaggcacggggccgccgctgaggggctgagaacccaggcacggggccgccgctgagggctgagaacccacgaaaagtttctgaaaatctccaaagcaggtgagatcaaaacggagttcagggctgccaggacctggtgggtcattattccagaggaagggaagggcaaagaactaagtctggtatcacaggttttcccttaaagccatttgccaaattcttaagctgtgaaaagcaagaagctaagcatctaagacagtcactaagacactgagcagtgttccatggcctcccagtgctgaagagtgagaaactggaagtcaaggctccctagggaagagcggccctagggaacaccccaggctgggaccactggtgggccaccccctagggtcaggtgaaccaccagctgcacaaaagctgcaacccagcctgaggtcagctgagtctgtggctggatcaaagtgatctgcgagcagcggctatctccagagcagagggcagaccctctctggaagctggcaacatcactcggagccctgaaaatcccctaaacataacttctgacatctcaataaacaataactaggcatatcatggggcaggaccaagaaaaacaaagaccacagaaagagactcagggatgaccacacatgacagttaccaaacgcagtctttacaaacatatgattcaagtatttaagaggacagatgacaagagggaaagtctcagcagagaattaaagcctggtaaaaaagaaccaagtggaaactctagagtgataaataaaatacaacttctgaaagtaagaacataatggatgcaacagaagagtggaataatgaacaggaaaaaagagtagaaaacaaccaggctggctgaatcatggagagaaagaaagaagtggaaaatgcaggagaaaaagagcccagaagacaggagacagacagggtattgtcgaagaacaaaaaccccgaggagaggcaaggtcagcacagaagcaatatgaaagaaactgcggccaggaatctccaaaaccgaccacaccaccaaactacagatgtaaaaagtgctaagcaccttctgagcaggataaacacaaagaaaaccacacgggggaagcacggtgtggtaagaaattaagaagtttctttctgagaaaggaaggcagagaaaaccctacccactcatggtggtggacgggtggtggcactgccttcagcactgagcctggaaagatgacttctcaccagcaatgagtgtggcaggctgacaagtgtcccccaaagactgactcatgtcctaagccccagatcccatgagcattacaccttatgcaacaaaagaagcgatgattcagttaaaggccttgggaggaagggcttttcctggagtatctgggtgggtcctaaataaaaccccacgggtcctctgagaggcagagggagttgagagagagacccacgtggaggacgaggtgacgtgaagatggagcagatgagatttgaagatgacagtgatgtggccacagcaaaggcttggcagcagccaccagaagctgggaggggcaaggaacaggctctctcctcaagcccggagggagcgaaggttggccaacaatttgactgacccagtggtcctgagtgtggacttctggcctccagaactgtgggaggataaacctgtgtgtttgaagccacacagtctgtggtaattgggtacagcggccacaggaaactactacacaaagagagccagggaccaggaatgatatctttaaagcacccaagtaaaacatccaccaatctaaaattctatatccagtgagaatctccaaaaacgatattaaaatggacattttcagacacaaacactgacaggatgtgtcaccaaaaaacctgcactacaagaaaaacatttctgcaagttgttcagcagaaagaaaacaaaatcagaagcacaaaactgcaggaaggaataaagagcaatggaaatgtaaaaggcaaaaaccgatgaataattgatgtgcaaatggacagactgagtcagagttaaagtatctgtagaattaaaatgagaaaagtatggccggggacagtgccttgcgcctgtaatcccgggtgcagtgccttgcactttgtgaggctaagacaggcggctcacttgaggtcaggagtttcaagaccagcctggccaacatggtgaaaccccgtctttactaaaaatacaaaaattagccagatgtggtgacaggcacctgtaatcccagctactcggcaggctgaggcaggaaaatcgcttgaacctgggaggcagaggttgcagcgagccgagatcgtaccattgcactccggcctgggcgacagagcgagattctgcctcaaaaaataaaataataaaaaaataaaatgcgaatagtatcaaagttagaaaagagataaatggagttagtggtttgatgtcttagaattatcagggaagtggccaaagcaatgatttctcttagcagtaagtcaaaggtgcacactgtgaggtctattttaacccccaaaagaataaaatagaaacaactaaacactagtggatgtgagaggataacagtagatgatataggggcagaataaaacaaaacacatgattcatttttaaaaagcaagaaagaagggacaaacataaacgaggtagaatgaatagaaaacaaacagtaagatgggaaatgtctactttatgtaatgaggtaaatactcttgatgaaacaatcaagactgccacaggggtgttcagattgtggaaattcctcacactgctcacttttctgtaaatgaatgtgtgcattgctgtatgtatgttacacttggataaaatttttaaaaagacagattgccacagtggatttaaaaagtcccacatgctgcttataagggatatttaaatataaagtgacagaaaagtttgaagtaaaagaaaaagataaactgtgccaaagataaccaaaagaaaactggtaatgtcaataaaaatatcacgtaaaatagactttcagaaagaaacattcctggagatcaagaagggcattttataacgataaaaaggttaatttaccaggaaggtgtaacaatgcaaaaggtgtatgtatctaacgacaacttcaagatatatattgaaaaacacctgaagagctaaaaggaagaatagacaaagggctattttttaaagacactagcaccaccggacaaatgccaaacataatggagatggcacctacggagaaaggagcagagggcacaagagtggaggccaaagagagtgaaggaaaaaaaacaaaaagcaaaataagagagaaaccttgccttgagtaacaggttggcatttttttttttttttttttttgagacaggttctcactctgttgcctgggctagagtgcagtggcgtgatcacagttcactgcagctcttgacctcccaggctgaagctatcttcctgcctcagcctcttcggtagctggaactacaggcatgagccaccacaccaggctaatttttgtattttttagtagagatggggtttcaccatgttggccaggctggtcttgaactccctgcctcaagtgatccacccacctcggcttcccaaagtgctgggattacaggcatgcgccaccatgcctggcctaaactttttctataaggggcaagatagtaaatattttaggctttgaaggcaaaacggcaaaattaagcaattgttatcagcaaagggctaatagacttttttacatcttacattttaagaagtgtaaaaacccatgctcagctcacagaccatttaaaaataggcagtagtccagactcggtccatggccaatagtttgccaacccttgtcccagctgatagtgacagtgggccatgaactacagtgtgatccactgaactccctaggcctaaggtcttcattgtaaaaagcgaagagagggagggaggcagccagctgccctacactctgctgctcactgccacccccacacctgattgccagggagggcacattctaggacagtagacagtagacacacaccagggccctgggagccacgttcctaagggcctcttgctttaaaggacaaatgcatcctttccacaagggctgtctaccaggggatgtctgacatctcctatcactcaactccagccctggactagcatcttgctccataaggattatacaagacttgttcatgaacacaggactgaggccagaaatgccgaagttctgcagaaaccgacagctcttggtcactaccaagcagcctgtaagaacctaaaaacaaatggcaagcaaggcactcagcagagattgcttcttgcctacccaatagctatccctccattcttcctcagtaactgaacctcttactgaggccagcaatgcacccagctaaaacatgccttttctttttaattattttttgagacaggatcttgctctgtcacccaggctggagtacggtggcgtgatcttggctcactgcacctccgcctcctgggttcaagggattctcctgcctcagcctcccaagtagctgggattacaggtgcatgccaccacacctggctaatttttgtatttttaatagagacagggtttcaccatgttggccaggctggtcttgaactcctgacctcaggtgatccacccacctcagcctcccaaagtgctgggattaaacgtgtgagccactgtgcctggccaaaacatgcctttttgacctctcttgcacatgcaagtggacaatgagatgcaagttgaagtcacaggttagggcttccagatagctgctgaaagaggcacgctcagctgaggcacacttctgccttaccactccttccttcctcctgctgcctgaaacagggacatgatggctgcagctgcattgacaggcggtgactgggaggatggaagccacaccccatagatgtggctctgaagatggcagcaccccccgaccaagccgaacacacaccttcagacttgcgcacaaaagcaaagtaagactctcttttgtttaagtccctgttgtggagctcctggatccacagcaagccccatctggagagcccactggaaaatgagctcagccacttgccttcaaagagtggaatggagtcactggaaaaggcatccaaggcgagcaggtctttcccgtccttggacccgctgcgtttgtgcttgtgtttcctccgaaaaaaggaccggcgtgcagccgctgacagcgtctttgtggcgctattgtcatctttgacttcagacatgctgagcctcctggagaattcttggtccatcctgtggcacaggggacaatgctgggcagggccatcgagaccctgctgccctgcccttcctgcccttcctggtgagaaaagcaaaggtgggccagacactgggctccccccacactccttggcaggtctcaaggctacatctcctcccacgcccctgggaaccctcggtacatgctgcgggggtgacacaaacaccagcaccagggcaagctctcagagcaggcgattttttctactacagcatattcagctcggtgtcaaaaggaactgctaggacagccttcaattggtgacatgacgagttacgcttcctgccatagaagggaaatgatgcagggatgcaggctgcctcgaaaacatgctcagtgacaggagccagatgaaaggccacactatgcaatcccaaccacacagaagtccagacagggagacccatgggtatcaaaagtaaagtagtggctgcctagggctgagggctgggtgggaggacagtgggataaggggctgacagctaatgggtctggggtttgtttgaggtgatggaaatgctctaaaattaactgtagtggcggctgcacacacctatcaatatgttgaaaaccactgaatggtacactttgagggagcggcaaggcacgagtatctccataaatccatttttctaaaacacgttatgccttctgacccatcactgtgctctatacagcactgactcacactaggagcagctttttagaccagcacttttggcaaaatgtagagagcagaagctaagataagaagcagaatccctcctccagcagccctggccccagccccctcccatgggacagctccatggctggtggccctcggcgacccctgccccaccccaccccaggcccggagaacacttacacatatttgctgggaatctgcccgcgctggatcttctgggcattctcgtccagctgccaagccatccaggacccgaacgtgccctggggtaaggtgtcatccacgtagaggatgtcgtccttcttaaagctcaactcttgctccacatctgccagccggtcgtacagggccctggaccacagcacagaaggaacacgatcaggcggctctggccaccaaggacgaaccaggtgccttctgtggccaggcccctaaggctgccattctgctttgggctgtctccaaacttgatcaggaatcgccgagggtggtgattctcaaagtggggagccctgtgttttacataaaggggcaaagactgcctttgctcccctaacactgagggcgcatccccatcaaagaactcaccaagatctgaggccataacttccctttccaggtggcctttcccagttgcctccctcctcgaagcccaggcccggcccctggttcctacagactggaatctctctaggatggaaatatgtcatcttctaccctagagacagggagttgtaccgcatcagtgttctcatgctttctgtgatcttggatcttaggaaatgtgaagaaagctctgagctcctcctagaaagcctgctgccatccctaaatgcccacagcatttcatacagtagtaagggcactgaagatgcctggaagtccacacacactgcagagggatctgcaaacctggcttgggggacaccagaaaaagaggagcacagcacacaggaaaacggggcttgactgcctccaaattctctaggtcttaagccctaaagagggggcccagctggttctttaagccctaaagggttgttctaagtcacaatcatctcaacataaataagcgtgcagattgagtgtcaaggaatgatgatcatggccccagccttggggggcaagaaacagagagccattcaccaggaaaagagtctccagtgaaagcctctcctctggttccaaatctcccaccgattccccagccactggtacctgatgtagaagctgtcaccaggcaggcccttggccttcgtgaactcctcagggcggtactgcaccttcaggcggacgccatccctgggcttcagcatctccacatagacttcctccactgtcttgttccgcacgtccaggctgccatactgccagggatgggggtggatgcatcagaaggcagaagccagggggcagcttgggcacccgagaggggccagtgctgaccatacggcagaaattcaacatccctccttaactgagactctggctacctcccctctgcaggaaggactgagtcttcatggtctccccagtctccaggtcctgtgcatgctccctggacaccaggtcctctgccaagtggctgccctgcccttgacagcttatccaggaaaaaccctgttctggtgactggcaagtctgggcttttcagaatagggaccttcctcttgctgatgttgcctgtgcttttatttatttattttctgaaacagggtctccctctgtcacacagactgagtgcagtggtgcaatcacagctcacagtagcctatacctcttaggctcaagtgatcctcccacctcagcctccagaatagctgggacaacaggcacactccaccacacctggctaatttttttgttttgttttctgtaaagacagggtctcactatgttgcccaggccggtcttgaactcttgggctcaactaattctcccaccttggcctcctaaaattcacaggtgtgagccaccaaacccagcccaacttgtgcctttatattctcacaaaccatctcccccatgaggcaggagaccacagagaaagaccatcctctctcatcagaacagagtcctgcagctacatcacctgagggcgagcaccccctgatgcccagggcctgagccaaggctctgccctcaggttccctcaatggcctgcctggcttcacagggacctcctcagaagggcttggcaggattctgggtttacagggattaaaaatcaaccctggccaggcacagtggctcacgcctgtaatccctgtactttgggaggccgaggcgggtggatcacctgaggtcaggagtttgagaccagcctggccaacatgatgaaaccccgtctctacaaaaaatacaaaaataaattagctgggcgtgttggcgcatgcctgtaatctcagctactcaggaggctgaggcaggagaatcgcttgaacctgggaggcggaggttgtggtgagttgagattgcaccactgcactccagcctgggcaacaagggcaaaactctgtctcaaaaaaaaaaaaaaatcaatcctgaggctggacacggtagctcatgcctataatcacagcagtttggaaggccgaggcgggcagatcacttgaggtcaggagtttgagaccagcctgggcaacatggtgaaactggtctctactgaaaatataaaaattagccgggtatcgtggcacatgcctgtagtcccagctactcggaaggctgaggcaggagaatcgcttgaacctgggaagtgaaggttgcagtgagctgagattgtgccagtgcactccagcctgggcgacagagcaagactctgcctcaacaacaacaacaaaagtcagccctgactggctcaccagatgagaggctgtactcctccgtctttggtgccacctgagatggcagcaagcccactgtgcaggtagatggaggcctggcctgctcagcagctcagaactcacctccaggatgaggtcccctggcacgaggccgtcaggacccttggcaggactgtcatcctccacctcggccacaaacaccccatgcaggttcccaccacacaagtgcaccccaagctccagctgggactttttgatgaagacaacgcgtggctccagggtcttcttgttggcatctcccgcaatcctttcaggaaaaaaacaaagttcctcaactgtgcacaaagaggaggcacaaaaagacaaagcagtggccaatgccctaaccgctttctgcctgcttcttggggtctcagaaccacagggagctgagaggtggcctctagttctactggctcggcgttcgggacaggatgctaaggtgcactggagatgaaggcaagaccccaggtccaaagccagttagcgggggcagtcaaaaccgtaaatcagtgcccctgctcccaggcccggctatcaatctcatgccttaaagatcaggatggcctccctcccatgtggatcacactcattttcctaacttagtacttcctaaggaaaggtaaagttggcctcactgtccagagcacagcaatgtattcagcaaatgtctacgaagaagcttctatagaccagcaactgctaacttgtgaagaggggccccttgccatcaaggcacttacaatcaaggaagggaagctgaaagtaagctgctgaacacatggagggagtgagatgggacagcgatggaaacagatacagggggcttcaggggagatgccagcccgggaggaaaaccttgcagcaggtaagttccaatgtgacagactctggtatagagaatgcagagctggcctcattctgtgagatgctgcccagggcttggtgaaggcctctcagtgctggagacacagctcctccaggacggcagagtgatcatgtcacaccatggcctggatggccctccctgcagccccaggccaggctggacgctgtgcagctcccatggagctccttcctcctcctgaactctgctgctccctcggcctggacttctctttatgcccactcttggctcttgcctgtcctgaacattttaatccagctgccacctcccctgccacactccagtgatcttcctgcctgctctgcggcggccggcagtgccctcccagcaccctgactctgctgcacgtgcccggcactggtctgccacctcattgggggaagcactgctgtgggtggccagagcccagggcctggccgggtgatgactgtgggaatgtgtccaaagacagactcagaaagcgagtgaacaagaaaaggagaagagaaagagaagatgcaggggaaaaaacaagtcaatagaaaacaggagaaaaagagaaaggaaaagagagagtagggaaggaaaaaaggaatgccgtgctcccggcccaactcctgaagacctggtgtgcggcctgcagcacatgaggccagctgcccagtgcccacgccacttggagaatgtgctcagccccacccagccgaagcggacacagggaaggctcacagcaacgtctgctgacctggagctgctctgcttggctgggggggtgctaggcccctcgtcctgctccatcagtgggtcgatgacagatggatgctccggggtggtggtgccactgccctggagagtggagtgggtaccggcagggtccaggtgtgagctggaggcggaggacaggagggataaggagcagtacgaagccacccagagccacccccactcctgtggcaactagatctgagctataaatggggaccaggtcacatagccctgcaccctgtgccctgagcagagcagacacattagaagcctggacccatgacatccacctgtcctctcccctccacctgtcctcagctcaggggccctctccaaaggcatctgacctcaggaagctgtgagcatcctgtctcttttcctctgcctgtgcatcccatctctcctgctgagcttgtggcgcagcactgcagggcatgcctccccttcttttctgcccttcaacccacagctcaggggcagatacagacaggtgtacagcatctgctcctggacagggagccaaacactttgagtgagaatccacccccggggccacaactcctggctaccatgggcccctgctggtcagggggaccacagccatctgtttccacaccccatttcaggaggagacagcctctctatatatgccccttttccaaaatccagggctggtcaactctctctttagcagcagtaggatccccagaacttacggctggcaccctgggtctccctaaaatgagcagagtgctgctgcacccacctctccacccccagcccagacggccctgggaggcccgcactcacctggaccgggagtggctgctgagctggtgcacgtgggggttgtactgggccaggatggtgatggtatcacactgctgcccgatgatgagccgcgcctgctgctccgtggcgctccgcaggtttatgccgttgaactggggaaacaccaggatgggctcagtgggggggtcggggctgtggacagggaggaggccctggggacttgggagcactgctgttccctaggaggaggagagggggaagaagtgcaggtttccatgggcgccatgcaggagggcagctccctctcacctccagtaactgatccccatactcgaggccagcctggtgagcgatgctccccacggtcaccttggagacgtagatgccgcccttctctccactcacgatggagatgcccagcggctctgagcccttctgcaccttcacgtggcgtggctcctccacataaggcctaaggaaaagtcaaaagtttcggggactcagggtcaaacaaaagggttggggagagcctgagctctctgatcaggcatatgatctgacagtgcagaaagggccccgagcctggatgctcccattgtgacacagctacatggggacatggtgggcccacccctgtgtgacaaacgatcacattcccacagcctcacgcaacacgagcacagcacacgcagacacgcaaccacccaggccaaagacacagagaacggtccgtgtgaactataaacactgatacatgtggattttcattacaggagaggagctgccccacaatatgcaattacaaactctggggggtcttgagatgccctccgaggaaaagagatggctcctgggatgacattccatcctaagggggcaacagaaaataatccagttttatgtttactggctacacagagtgatgcaaactggtcacggaaattaagctgctgcagacccaagcctttgtaaagggagaaggctgggagcaaggctgcagccatgcacttgctgccctggggctgtacagtgcacccaagggcgccggggcaggggctcggcagggagcctctgggcaggccaactgcatggtggaagacctgggcctggtggccacgggcagcctcagaagagatctgtggtggcagagacatctggaaggtgacaaaggttagaaagaagataagggacgctcagaggagaaagacaatcagagacacctggaacataacagaaaagacagtcaagtgatgcggagcctcccgttgggacttcacgccactcagggcttcattcctccaaggtatggacacctgagattttcctcgcaggataaaaccatatagccaaaggctgagggggccagtccaggtcccctctacagcacatggtcaggatagattctagcggggaggcacctaaaccaccccaccccggccacctggaggcagagcagcttcccacttggcagtctcagcctgtggccctatgccccagccctcttgggaaggggaaattaaaattcttcttgagttgtccctgctctctcccaccctccaaagtgttcccacttcccaaacttgcccactctggaaatcctcccttgaccctccagctcagacagatccaccccagactacacccacggtcccttccaattcaacacggattacagccccgtgctgttgagagctgcagagccctcagcacacagccacccctacatcaccctcctgccccagccttagatgatgaaacagaggcccagagcagaaagaggtccacctccgtacaacacgtgtatcacaataaaggagcaagcaactaagtcacagcaatagccacccaatagaacaatgatctgaaccaggttcccaggttccagtgacatgcaaagacgtaagggacacaccacggggtggggaggcccgatcggcatcatttcacttatatttatctgcatctgcaaacaaaagtatgtgtggatttatgcacaaggaggcttcttatgtaggacattaccaagtgttaacaatggtgtctccagttgaggggatctgagctaatcttttttttctttctttttttttggaggcagattcttgctctgtcacccagggtggagtgcagtggcatgatctcagcttgctgcaattccacctcctgggttccaatgattctcctgcctcagcctctcaagtagctgggattacaggtgtacaccatcacgcccagctaatttttgtatttttagtagagacagggtttcaccatgttggccaggctggtctcgaacccctgacctcaggtgatatgcccgtctcagccacccaaagtgctgggattacaggcataggctaccgcgcccagccagagataatctttactttatagtcttctgaatgatttgaattgtttgtaatatgcatagaagttttctctaaacaacagctgcttctcaaaagaggtttataaagtatacttaaactattaaaaatagctaaaaacataatattaagggagatttgattatgtacataaataataaagcatgtttatatatatatatatatatatatatatatatatatatatatatatccaaagggtaatggcaattgaatctcttgttgaagaaataatctgtgacttttttcttctttctacttttctgttttttattttttgagacagagtctcgctctgtcacccaggctggagtgcagtggcgcaatctcagctcactgcaacctccgcctcccgggttcaagcaattctcctgcctcagcctcctgagtagcagggactacaggtgcctgccaccgtgcctggctaatttttgtatttttagtagagacggggtttcaccatgttggccaggttggtcttgaactcctgacctccagtgatccacctgcctcggcctccttacaggtgtgaaccacagcactcggccttctttctacttttctatgtctctgattttccataacaagtataaaatactgtacttcagaatctgggaaacggggccatttttaaaaagaaagctgttgctcagtcaggtcacacatgtcaaatttcatctccaatcggatcctaaccaccgtgagggcaggagtcactcacatttttctccctcctggagcaggtcctggctctccgtgccctgtggggagctaagggaatgcttggcagtgggtggcaaggccttttccacaactgaagaacccacttcacttggggaaggtcccgtcctctctgtggccagggccggggctgagtaaaacaggccagcatgctcctgcgcgtgccacatggtaagagctccgtcagcatttcttccgagttacacccgattcccctactggggccaggcctctgtgttttgctgtccttccgttacccctcaggttctctggttggttgccttttaagttcagattttcaagtcaaatataagattttctctggctgggcacggtggctcacgtctgtaatcccaacactgtgggaggccgaggcgggtggatcacctgaggtcaggagttcaagataagcttgaccaacatggtgaaaccctatctctactaaaaatacaaaaattagccaggcgtggtggtgggcgcctgtaatctcagctactcaggaggctgaggcacaagaatcgccttgaacttgggaggcagagattgcagtgagccaagattgcaccactgtactccagcctgggcgaaaagagcaaaactctgtctcaaaaaaaaatatgttttcttaacatagggcccacccctgctgaggctcacagctacagaggcctcagctttctggactcaaatgaaagagagtatctgtgtttcttttggtgattaaataaaagtaagtttatcagagctctttaagatctacaatctagacagaagctgttaaatataaacacaatctagtaagttccatctaggggaacaacagagagggatgtgtgtgcacagtgcgcgggggtgacggattccatggaggaggtgcctctggacagacagcaagcctacagtcaacctgaaacctaagatggacctacattctaaaatgaaccagtaccagtaaaaagctaggctgcacatttatgctttcttcctgtgtatattttatttcacaacagaaagcttcgaatgagagggaaaaagcaaagggtaagaatgagtcccggtgccagccactaaccacgtggccacaggtctgtcactccaacgtctggatccagtttcctcaactgtgaaacagggataacaataataacgacactggcagggtccctgtaaggatctcgtgacttagccacacgtaaagtgcttgaacaagggcccaggaaggtgtaaatggtgccatgatggcacgatcaccgtcaggtcatttccagcatcatctactgtgagccctcttggctccctgccttgccatccacacacgccccacctccctgcatccagtgccccatggcacttactggtgacaccagcaaatgctgggacactcaagctactcctgctgcttctactaagccccttccctgcagagcccaggcccgctgccgggatgcacactgtccactggtttacccactccaccgatgaccggccatgctcacctgtcctttctccgctccccgagggacgcggggttgacagcgattctgggcaatgtggaggctgaggtctgggactggctacaagaggacagggtgtcgatgttcaggggtgactgtggaggagtgctgcattcagaatgtgacactgaacctgcagagaggagcgggtaatgccggtgtgaactcccatctcacttccccaacagccaagaccaagaggcaggtgcgatccagacacacagctctatccccactgcatcgcatagtctggagctcagatgctaggctctgcattgccccctaccccccacaccaccaggcctactgctgggctcagtgaatttttactgactgactgagatgactatgaagttctcagctaagcccagagactccaccatgaggagtcagaccgcaggaaaagcaggagagatgggaatgtcgagaagtccttacctctctcggagcccacgacactccgcggatatcttggtgttgatgggattttaatgcgttccgccttgaactgcaagttactcgaagaacctattgttccataagggaacaaaacttcaggcctcatggttaaacaccaccctgtccttcctctccaccaggctaccagtcaggataataaatgcaaagctgggccctgctgtttattcccaagggagccttgatatggaacagtcaagaaaagcagacgtttaacatttatctcaatgaactgtgcaggcccagactgctccagaacaggagcgcacaagtctcacttccagccacggaacagcagcctaagagacacggcagctgctccatcttttctccccagcgccagagttccccaagatctccatgggctacctttgtccgactctcctctggggttcactttccatacaaaaatgtatgaagagccatacaaaacagtccagaatgaggccaacaacctcagggacacagagcaaggctcctagctgaggggtcacctgaatgaccataaggcccccacagaaagcggaaggcgaaagcaatggctctgacagcagcatgggcatggctggcccatgaaggaagcagcccttcccagtagagaaatgagctcagtcccaggaggtgacaggagctcgtgtggggagcccacccgcagatctggacattaggatgcaggcagagatgaaaagcttggcaccctctgcagcacaaagtccaagtggtgcagttacccaggcgggcgctggagggcagtgagttggacccatgggtggctctcatctcggagtagtcgctgcaggtcctgtggctcaggtccaggctcaggcgtccctggtgctggacactgcgtaaaaacaagaggtgaggagttcgggaggagaaccaggaacagatgtggccactggggagaaacacacagaccaggcaagggttcccaagcgggcagaagggaggcccaggagccactgattatcagccgaggatagcaggctgccctcagccactcccggaggtggcatccactaagagccttcaggaagtagaaagggccacacacatggggcggtcagtatcatacccactccagccatagggtcaggattaggctcactaggaagaagtgataaaaaacagaggttttgcaacctgggtgggcctggggagggggaacctgtcctcccaggaagtgggtaaggagagacaaggcacagaggactttggggaggggacctatgtgcctcactcgggacagcgtgcctaagaaaatgaagggcagagcagggatcgcccacatcaggctgccctgagaccaggcctcaacagcatctttttccagctatgtaatgaggtgacatctcttccctgcttaaactctacagtggtctccactgtccttagaataaaatccaaactcttcatcaccgctgcaggtcccacagggtttgtgccctgtgacctcaaacctcttcttgactcgctgcccctttgacaagctcccacgactgtgcctgggtgccctggccttggcaccgatggcccttctccctggaggctccagcccaggtcttgtgcagctggcctctttcatccttctggtcacagcagcatcccctctgccacagggcccttcctgaccacccactctaacttgccaccctcttccaagttacagcccagcctgtcaccctgtttgactgccttcatagcctcttggcaccatctgatatcacttcgttcattttttttttttgtctgcctcccacatttgaaaaaccacacgacatgagctagaagctaatttgtttagttcagcaatgtatcctcttataattaggatagaccaaggcatgtagtaggtgctcaaaaaatatctgtcaaatgaatgaataagagtggcttggagccagcccaccctcttatgaagtaccagtttcctcatcttcaagacagaaacagtaataggacttagcccatgaggttgctgttgattcggtgaaatgatattcataaaggtctgagcacagtggctgggacataagcactcaaacatcagctgctatcactatcgtgtccttccagtaccttttgaaaccttgtgctgatgaattcagaaagcagccctaaggctccctttccctgtgctgctctagccagtcccctcccaggcaggcaaggaagcttctccaccaatgagcctctttatgcactcatggttccatgtccaggcaggcttgggcagctggagtacagagaagcgtagggtgccttcacatacctgggatgcaaaccctgggggccagcatctcgggccgcaggtggagagctgcaggggccgaccctgtgactgcgcacagtgtagatggggttccgcaggatggagctcacagtggtgctgggggtcaaactccggggaacagtgcctagaaatgggcttggtgagaaaagacgccccaaaggacccagccagcccaggacttacacaagcctttcccctgtatcccaggacgcagccgcagtcttttgggaaaaggacttgggagatgagttttaaccaccaattcacaatgtggctgtggctcctggcctgtctccatttgtaaaaaggggggaagtctctttcatgcttcctatttcccaggttgctatggggagaaagcatgttgacaagctaagacatgtcatggctataagacaaaccatcccagacaggacagcatttcccagttctctggacctcagggctgaaaacacatggcagctctctgaaatgctgcctcccctctccctggagactaggcatcccgagtttacaccgaccctcagccccagcccctggctggctgactcacccacagacggcctgctagggtatagcggggggttgctgtgccggctggaatgcccaggcgagtaaggtgcccactcctggagctccggggagagttctccactggccgggacacacttctgttcctgcagatgcaagggcaagagtgtctgctagaaagagtggagtgtggccaggcgcagtggctcacacctataatcccagcactctgggaggccgaggcgggcagatcacctaaggtcaggagttcaagaccaccctggccaacatggcgaaatcccgtctctaccaaaaatacaaaaattagctgggcatggtagtgggtgcctgtaatcccagctacttgggaggctgaggcaggagaatcgcttgaactcgggaggcagaagttgcagtgagccaagactgcaccactgtactccagcctgggtgacagagtgagactccatcttaggggaaaaaaaaaaaaaaaaccaaacagtggaacgcttgagcagctctgcaagccagtttctgccccccaggaaccagctcctcccactggggcacaggaagggacatgaatgggaacgctgcccattcatgttgccttacacatcttcaaggaagcagctttacttcagaagaaaaccacagagaatgaatctttcacagagatcacgtaaaaggtgagaatgcacaagtgcatcaggcacgtacaactctgcccgatgtggagggctgtgcgaagctctttgtccccagtgagcagtgtggactggtgcctgagatgctttccacagtccccagcaatctcacccttctggaaactatgacagcacacgcaatcaggccgtcccgctgcccactcagcctcacacgtgccacctcatctccctagcccttcaaggcaagtctatgccctaggttttattgtgtaagttcaaaagcttcttattaaaaaagcaaaccaaatgctatgcccaataaagtgttcccctcttgtgtcacactcccactaccatgcacttccacgccacttacctacctcctagctgggccacttcccacttgagtccaacagcaaaggcaaaggcaccaggctaaacaggggcctgggacactggtgcagggccacttagcagccctccttcggccaactgcccctctctaggcctcccctccccacaccctggggctcagctatacctccaggaactgagcaggaatcactactggagcaagcttcggccgaaaactgggagcagattttggccggcgacgcttctgccccagctcatccaccttctgggaggtgaggtcctcatcacaggatttcttggccggcaggtgggaggagtccccatctccttcagggtagtagctggaagcaatgcggaccctggccttgcgagggggtgatgcgtgcatgggctccccggggtccacgtcagggggcagggcgctcgggggactagtggatggggagctgcccaccagagtggcttctgactcggagctagtctccagcctgtgctggaacttaatggagtcgctccttctgggaggttttgggggtgtcagaggccccgccctcttggagggctggggagagtgagcaggcccaggacctggaagcaggtagtctattttggggggtgtctgggggcgtttgaaagtgttagggtcaaagatggactttctttgctttggctttttataaacagagagcttctcaggcactgccgtggagctgagcatggccttgggccaggtcccgccgctgttggagccttcagagtctgccttgtccagggaggcctccccaaccccacaggggcccacctcggtctcaaagggcagcagtggccgccggccacgcacgtccaccagcccaaagccacggtccccagaggcatctgagcggaaggagctcaggctacgctcagaggcactgggacaggcctgggggcagacctgcaagggtcccccagggaatggcttatgcagaaaggagctgctgcctcctggggggcctggctccttcctgtcttccagcctgtccgtgtagaagatgtctgtctgcgtggagttattgtgctgtatcaagttccgtttgttatgagcctggacctccgggccatgggctcgaaaactcagcatcttatcagagtctttgatattttcaaaaatgttctggccactccacgaggagctctgagggaatacctaggcagggattgcagaggagtgagagagagagtgagatggcaggacttggagctgccactgaaaaccatccccagaggtaaagcaatggtcaggaatgggccacctgccccttaaaaaagagacagatagacagagatgcacacacacatgaacacatatgcttctccctaatggataagttttctcatggctctggtcactctgaactcaaagaagagtcaaagttttcttaactttgaacactttctgaaattatctgggccgggcacagtggctcatgcctgtaatcccagcgctttggtaggctgaggcaggcgggtcacgaggtcaggagttcgagaccagcctgaccgatatggtgaaaccccatctatacaaaaattacaaaaataagccaggcacggtggcatgcacctgtagtcccagctacttgggaggctgaggcaggagaatcgcttgaacccggaggtggaggttgcagtgaactaagatcacgccactgcactccagtctgggcgacacaatgagactctgtctcaaaaagaaggaaattacctgcataatgtcttgaatattttttttaaatattaaacataaaagtaaaaattcattgttaaaaatatatctcttgtggtacacccagacaacggaatataaattagcactaaaaagaactgaaacaacgtgcaggaaccttaagtgtatattagcaaatgaagaagccattctatacactctgtgattccaactctatggcattctggaaaacacaaaagcatggaggcagtaaaaggatcagttgttgccaggggcttgcataaatatggggagcatagggaatttttagagcagtgaaactactctgtatgatattacaatggtagtacatgtcatcacctgcatcaaaactcacagaaaatacaccaagactgaaccttaatgtaaactatgcattatagttaatactaatgcatccacattggctcactaattataacgcatgtactaactacactaacgcaaaatgccaaaattggggaaacttggggacaggagtggggatggtggtgatggggtggttgagagagtgctaagaattctgtatcagcccaacttttctgtaaacataaaactgcttccaaaaaagtcaaataatttgaaaatagttaatttagaaaacatctcttaatagaaagttagaaaaaataggcccagccatttcattaagagatgttttctaaattcggcctattttttctaacttcctattattaaacttttcaaatatgtagaaaagtataataaatgtccataaatgtaccatctagattcaaaaatatttcactaaattgtctttttgtctataatgatactacagaacactggaaagcaagttacaaatatcatgacatgtcacttcccttcctttttttttttttttttgagacagaggttcgctcttattgcccaggctggagtgcaaaggcgtgatctcagctcactgcaacctccgcctcctgggttcaagcgattctcctgcctcagtctcctgagtagctgggattacaggaatgcaccatcacatccggctatttttgtatttttagtagagacggggtttctccatgttggtcaaggctggtctcgaactcccgacctcaggtgatccacccgcctcccaaagtgctgggattacaggcatgagccattgcacccagcttcttcctttcatttttgagatagggtctcactttgtcacccaggctggagtgcagtggcacaatcacaactcactgccacctcgacctcccaggctttttgtattttctgtagaggcaaggtctcgctgtgttgctgggctcaagtgattcgactgccttggcctcccaaagtgttggggttacaggcatgagcaaccatgcccggccatgacacatcacttctaacaactttagcttgtacctcccccaaataaagccattctcctgtataacaaccccaatgccatcatcatacctaggaaaactggcaacaattccctaagatcatctaattatcgggtccagattcaaatgtacccaactgtgcccaacatggccttgactgctgttttttgatttcagaccagcgtccagtcagggttcctgccccctctgcactcagtaaatgcccaccctgttctcaaggatcctgtgaccccaaggagtagcatggctatgtggagccggggctctgcccatactcctgaccgtgagagcagagccaggtccagcccttaccttcaggagggacagggtcagggagtcctggcagctgcgcagcagagattcacattcattcagagacttgttgtccagtgcaatgccattgatctagagcaggacagagagcatgtcaggccacaggcagagcggcctcaggcctaccagtcaggatctctgcctacctaacctcctgtgctagacagtcaccaaatgcaaggtgccaaagtcaggagttggcaaaggatagaggtctttctggtgaggcccaaggagtccaactaaggggattctgaggtagaggaacacataagccttcacagcaggctaggggaggagcatgtccttctgggatcagaacaccgaggacccggagggaacatcttggcactgctgtgcccggccatgtggcgtgggaccttggctcagaacttcccagctccttgcctccacagaggaaatggaagataaatacatgcatgtggctcgggagagcgggggactaaaaacaagaccatggataggaaaggccttgtagagaaagtaccacgcgaagtggggccctgtgagtgttcacaaagaacctctcaaccctgctcccggaatctctgctcacagctatgtgcagaccttcttaagaagtatatgtgcaaccggtgaatgaccaaactgtgatacacccacattgcagaacactgctcagcaacgataagtaacaagcagccagcacacgcagcctcttgggtggatcttgcaggcatggtgcggaatcaaaacagcccagctccaaaggtcacatactatatgattccatgtctgtaacattctcaaaaggacaacatcacagagatggagaaaaaatcagctgccagggggcagggatgggagggagcagggggtgttactacaaatgggcagtgggagggagacctcagtgctgatagaacagctacgtatcttcattacggtggtggttacacagaacaacatgtgtttaaccacacacaaccacacacacacacacacacacacacacacacacacacacacagtaccaatgtcaatatgctagctttgatattatactcatgcaaggtgcaaccatgaggggaagcagggagaagagtacataggacccccctgtactatctctgcagcttcctatgaatctataatcatttcaaagtcaagttttcttttttttttttgagatggagtctcgctctgtccctcaggctgaagtgcagaggcatgatctcggctcgctgcaacctccgcctcccaggttcaagcaattctcctatctcagtctcccgagtagctgggattacagatgtatgcctccatgcccggctaatatttttgtattttagtagagatggggtttcattgtgttgcccaggctggtctcgaacccctgaactaaggcaatccacccgcctcggcctcccaaagtgctaggattacaggcgtgagccaccatgcccggccagtcaagttttctttttaaaatatctgcagagtgattatctggaagtagtaaattaatttgtggttttttccttataacatatccacatttaaaaaattttcatagtggccatatagcttttacactctggctccccaaaaaatctgaaaaacattggcaaagatgtgaggcaatgagttcccccacacactgcagggaggactgcaaaagccatgacctttttggagcaaagggggaagatctcgctggatgttaaacattcatgtcctctgacccagcaaaccccacccccaggaatgtaccccagggcacactcctgggtccctatgaagtagcatgtcagtggccatgcagcacgacacagatgtaagtaagggcagagatgcccagactatccctcgggagggactggtcaacaacttaggctgctgccactaaggaatgacacgcagttatatgccttggggcagatctaaagacgtgaatgtgggctgggcatggtggctcacacctgtaatcctagcacttcgggaggctgagggcagatcgtttgaggtcaggagttcaagaccagcctgggcaacatggtgaaacccccatctctactaaaaatacaaaaaaactagcagggcgtgatggcacatgtctgtaatcccagctgctcaggtggctgaggcaggagaatcacttagacctgggaggcagaggctgcagtgagccaagatcacgccactgcactccagcctgggcaacagagtgaggctatctcaaacaaaaataaaaacaaaaagacatgctgctaaaatctggctgggcgtggtggctcacatctgtaatcccagcactttgagaggccaaggcaggtggatcacctgacgtcaggagctcgagaccaggctggccaaaatggcgaaaccccgtctctactaaaagtacaaaaattagctgggtgtggtggcgcatgcctgtaatctcagctacttgggaggctgaagcaggatagttacttgaacctgggaggcggaggctacagtgagcccagatcacaccattgtactccagcctgggcaacagagtgatactccatcttaaaaaataataataaaaacaaaaacaaaaagcaagatgagcaactgagtatattataatcccatccaggttacctcaaccccccaaaaatgtgtgagatgtacatgttttgaaagtgtctgggacataatataataaattgttaacagtgattgccatcggggtgggaagcagtacacaagaggtctagccagaggaagatttgttgtcacgatttgccttttgtactactggaattttgtatgtatgccatgaaaaagtgtatggcattttcagtttttgttttttatttattagagacaggagtcttgctctgtcacccaggctagagtgcagtggcgcgatctcggctcactgcaacctctgcctcccaggttcaagtgattctcctgcctcagcctcccgagtagctgggattacaggcacccaccaccaagcccggctaatttttgtatttttagtaaagacagggtttcaccacgttccccaggctggtctcgaactccctacctcaggtgatccacccacctcggcctcccaaagtgccatgattacgggcgtgagccaccgtgccccgctggcattttcaattttaaaaggtcagaagtattaaatttgcatgtcctatgactcagcaatctcacggcatttgtagcttagtctcagagataccattacatgtctccagaggctctgtgcacacaggtaaagttcaatgcaggactgtttgcaattgcagaccctgaaaacaacttctatgtccatcaataggtggataatttaaactacatataatcaaacaacagaataccataaggtgggtaacattagccaggctacacttggaaagatatccaaggtaggatgcgaattgcagatcccattactgtacataaataagcaaaacaacaccaagaaatctatctaggtatatatagatttgtaggggcacatatggtttgggctgagtgcttatcttctaaatgggggcagggacaatctctaggagcaggattaaagggggaagaaagggactgccacttttcactttacatatttttatattgcttggctgttttacaacaaacaggacttactttggtaacaaaaaaatttaaaaataagtattacatttagttaaaaaaaaaggggtggcatttaaaagtcacaacacaatgatgtcaatttttttaattgtccttgataaacattcatgagaatgttaaatgtagagaactacatttaaaatgttaataaagctgggtgctgtggatcatgcctgtaatcccagaactttgggaagccaaggcgggcagatcacctgaggtcaggagttcaagaccagcctggccaacatggtgaaaccccatctctactaaaagtacaaaaattagccaggcatggtggtgcacaccctgtaatcccaactactcaggaggctgaggcagcagaatcacttgaacacgaaagtcagaggttgcagtgagccgggattgcgccactgcgttctaacctgggtgacagagcaagactccatatcaaaaaaaaaaaaaaaaaaaaaaaagttaatagaggttatctacaggtggtaccaaagcaagtggttcttatttcccgcttaggcctttggaggttgcagtgagctgggattgcgtcactgcactccagcctgagggacagagagagatagagaaaggttatctacaggtggtagcaatgcaattgattcttatttccctcccagaccttttatttcctaattttctacagtaaatagaaacataccatcaagaaacctatttttaaatgttcacatagtacaatgcccacaacaaggaaaatataaaaactttgctcattacttcttgctcaaacctcccaaatgtaatctgcctatgcacggcagatgaccctggctccagccttgagacttaccgcaacgatcctgtctcccacagcaagggacccttctttagcggcagggcttccaggcagcacagcggcagcatacactccattctccagactgatgccactgtctgcaagccacaggaggtcactgggtagcccctggcctcgctgcccagccctgggtcaccctacctcatctttgttaccatcttcttacaaaagaggatgtcagcaggctgcgccctgtctacgcctgcaccctgccccagtcccaccaatcgggggctcagttacatctaccctggtgaatcaaacactcagaaagcaagactcagggcccagaccacctcttgccagaaaagcacatgggctacatttaaatggcattggcccctcatccctgtgaatgaggtgctctaaggggcacccccggcccctgtccacaaaaaagggccccagccacctgaggcactctgccatgttcacaggcccgctacctttctgtccactgaggttgatgtgcagcggcgtgaccaccttcccacccagggacttcctccgccgcacgaccatgttgatggccccctccccattgaggagcgccttgatggcctgcttcttgtccttgttgatgaggtccacatcgttgattctcagcagccagtcattgaccctgagaaagggcacagccagttcagcacccacacaggctgtgggaccagcggctaccgcccacaactctcactcagggggctgactgccaaggagtgggtgcctcacatacacgctcagaaaatctcctcttgcaggagtgcacagtggtgaaatttgcaaatgctgaggttagacagcctgggttcaaatcctggccctaccacttactagttgtatgacctagcccctccaggcctcagcgtcttcatatgtaaaatgggggcaataatcacgcctaccttgtaggattgtaaagattaatcaattaatttctataaagtgcttaaaccagtactcagcaaatagcactgtaatagtgttagctattttatcatcatgactatttccctgaatgagcatgccatgtacatcctgggctctcacgcataccccttgagcactttcccacccaaaggagcaaaagacagtacctggtaactaaagaataatcagattcagaggcaactgagaagcactgtttctttcggagcattattagctgctgagactgcaggccttggacagactgtgtgtgagtctaaggctgggaaacgttcacctaagtgctacctggctctcttcgggtcctctgcactgggaagaagggccccaccttgcctccagagcctgggcctcaactcttaccttaagcggccatcagcaatgcttcctttgtccactttagtgacaaatatgccacagtcccccgggaaacaaggctcattcacaccttctgccatatcaaaccccagtgccttcaagtcaatatcctcctgcaaaaacagcagcaacagcaacgcatttcacaaagcagtgacagagacatttggctcttaagccccgaagctgcccactccaatgtgggggactgtcccttcacctcatctgataagacactccatccccaggatggaaacctatgagtatctgcaacctgccccttctggccactgcagacagacatccctgtcagcgtcctccgaggaccctgcccttccccagctgcaacccagcctggacagctgctgggaaaggatgcctcacactcctgggaggaaaaggagaacctccaaacttggagtggtgaaactgggagatactgcaagcgggtcaccgtctcctccttcatccatcagagaaggagagaagaaccatcagaggcagcttaccgtctccctctcgaactctacaacttccgtttcccactccatggaatccgtgtcaatggccgagtcgtgggagctgtgggccatcagctgtcggaaccgggcctccttttccaactgggattccatctgttccctgtgaacagagagagccacggtgacagccccttgggaggtgaaacatcccaccgcgtaacggctctgaacctcacgaggcaggccatttgaaacagctaaaatgggttcctttcccccttgtttcccaataactcagagtcaggtcaaggctgctgggatatctgtgagttttcacagtggttttttaaaaaagacaaattctccccaaatttatctagaggtttaacacaattaaaatcaaaatgccagctgggcacagtggttcatgcctgtaatcccagcactttgggaggccgagacaggcagatcaccagaagtcaggagtttgagaccagcctgaccgacatggtgaaacctcgtctctactaaaaatacaaaaattagccgggcgtggtggcatgtgcctgtaacctcggctactcaggaggcaggagaattacttgaatcagggaggcagaggttgcagggagtggaggtcacaccgctgcactccagcctggcgacagagtgaaactccatctcaaaaaaaaaataaaatttaatttaaaaaataaaatcaaaatgccaacaagatttttgtagatatagacggctattctaaaatgtatacaaaaaggcatcagaatcactaaaactattttgaaaatgactaaagtgggaggaaactctctacccaatttaagacttagtatacagctacagcaatcaagactgtgtgctgctgtcagggagacagacacacaggtctgtagaacagaataaggaacctaggaatgccccaagtcaccaaaggtgcataagttaacagaggaaggacagcctccaactaatgatgctggagcgactgcacatccatggccaaagaaatgtatctcaacctaaaccacttaacctcggataaaagttaacgccaactatatcacaaattgaaatgcaaactgacagaagcagcaacagaaataccacttaaatagttatattaggatgaagatgtagttcttaacatttcctttaatgccattgttacaattttaaaaaatgttcactgatggccggatgcggaggctcacgcctgtaatcccagcacttcaggaggcagaggtaagtggatcacttgaggtcaggggttcaagaccagcctggccaacatggtaaaaccccgtctctaccaaaaatacaaaaattagccaggtgtggtaacatgcacctgtaatcccagctactcaggaggctgaggtacaagaatcacctgaacccaggaagcagaggttgcagtaagcaaagactataccactgcactctagcctgggcatctcaaaaaaaaaaatttgatagatttgacttcatcaaaattataaatattagctcagagaaagacctagtaatgaagatgtgaaagagagactcagaagcctcgttatatcctcaggtgacttgcctgtgacacccttcctgaaatctgggcccaggctgccttgccagctcatgaacactgcccactgggctcctgacctacttgtgtttcctgctccagcagacaggccccagggccgcacctttgcctaggctgtgctctcaccagccagctctagaatgccactcagcctccagggcagagctccaatgccttccaacactgccccagcccctccccaggccagtgcagctgagctcagcattcattgctcactatacctgtctcatctggcattaccagggagtgcctgaggcttcccaggcagcaacacagaccccctcaccagcatcctgccagttagagaacttagcagacaggaggcacaaatgcaaacatgctgaatgaacacacaagctgaatgcacaagcttcaggcaactctggcccaaacaagaggcaaaatgtcccatgttcacggccagagattctaggctttcccttcgaagagaaccccttgattccatcacattgctagacccaagatggttcctgtgaagagtcttgccttgcctcttaacccctataatattcctgagagcacccaagctccagagagtctgggtttttatagaataaatggagctctttgtctcattaggaattttactgaatgggaaagaagagaagctgtcactcccttctgacgggcagcacttgagtgtgcaaggcttgcacacttgcactcacacacgagcttctcactgccccctcaccacactaacagctagggaaatgtcgcacaatggatggagagccactgctttcctactagatttgggttttagaccacggcctattgggctctgccaatttctatgcttaaaccctgatctttgtatttcaatgcactactaaaggccactgagtgtttaaatgacaccctgggaggctgctgtaatcgaggggaggatgtctgacaccccaaatggtcttccaaatggacgtccaaataacacaagcagaacagactgctggatgggggttgcaattgcctttaaaactctaatcacaatctgtcgtcatcttactcatttacgtacttgtctcttagatggacctgaccttggtctgtgtctcttcctgcgcactgtgagcccatgaggaaagggacttggtatgcttgtcagtgccatttctccagtgcctctaatggaggctggcccatacagagcaggtacttaaaaaatctctgcgagtgagtgagtgagtgagtgagtgagtgagtaggggaatgaatgaatggataacacatgcatgcctgccccagatggactgcttgggaacagggtcctcccttcctagtgccttggcacatggtgcctgccctgtgtctaagaatttttggcctaagaatttctaattaaccctacatggagatgacattcgaacccattctacacactgacagagtaaggcagagtgaagtgaagggacaaacagccagctcgacgcagaaggatgaggccctggccaatgcactcagcattgccttgcccagaagggagaggggccccaggctcccagatgcatgcccactccagcgggtgcccacccgagcctacttgagctccttcagctcgcggctgacatcattcttctgcttgcgggtgtcatccaggctgcgcagggcctcagccagctcgctcaccgcacggtcccgctcccgcctcaggttgtcacacagtgtcctggtggaaggagcagaggacaaggtcatctcaagaggcatggggaagggggttcctggtctgcagcggatggtctggccacctcactccaaatacctgccggcacctatcccatccccagatgcacaggaacacttgggaatctaggggtaagaccacctaggccagccccagtgcatgacagagggaatgtggaggacctgggcagggaagagacacccccacagtcacccggcaacaagtgtcaggttcccaatgccctgtttcaccctcaatgtgcctggggttaaggaccaccctctgcacacactcactgttctaatgccaacttggggagccagggggtggctctcctctgcatgaagcaccccccacctgcctggcaggcctgtgctccagcactaccacatgtctcatatctacccacaggcagagctttctagagctgtccctgtaccctgcaactaggaagggagccccttcggataccagccagtcctcatgcatctctgtctctattagctctgtgcaggtgcaaagtacaagcttggcaagactctatgaaagaggaccccaaggaggtggaaacagattacctggctgtggaggggcctgggctctgtgccacctccagaaatggacatacccagaggactggttcctacctctccacagcctcgaatctcccccagcctcagtcagagcctggctgaggactgccccctggagacacccgtggaaggggtctgagcagaagcagacaggaagcagcccctgggcctccctccccttgcactgggcacctaactgtgctctccattagcagggcctcaccacctagccatcctcatctcctgaccagcccctagagacattggtctctcccctgacaaaccacaagaaatcttttggacacctcccaaatagcaagacattatctctccccaccccaaacatcaccaccaccatagcctctcctggttcctccccagccaaggatcaagcccacactgcttggcttccctttcaaggcctctacacctgcccctgggaatctcgccagcctgccctccccacgacttgcccacgtccctgccctgagcacactccacaggtgccctccatctgcaatgcccttcccccttttccacctggaaaaaccccactcatgcttccagttctagtgcgaatgccacactctctggggagacctccccacaccccagggagccctgcatgccccccacagccctagagctcagttacacatcttcctccctcactgccgtgcctgaccaagcctctcccaaggtctccttgctccagagatctaagaccctggcacacagtaggcgcccggtgaatactgctgaaaggacacacttcggatgtgctcttctcatcagaaaccctcaaataaaagaggtcggcctcgtgccccttcacagcggtctcacgtggacatagtacacacttgggacacctagggctgagtgagatgggagggagaaacaatggaaaattctaaaactaagaggcaaggctagggcatcaactaggggtgagaaaggaggagcccaggtccctcccactttacctggacatacagtaaatgattccgaccctcccaacagaccctagcaggtcccctcatcctggggagacgcaagcccacgccagcttgaggtcaccccataccggatgctgtcacgctctgctacaatcttgtctcgctcctggaaggcccagtcccgccggcacttggccacatccgcctcctggagggcttccttcagctcctggcacagagccttgcactgctttcgaaggatttcaacctccttgttggctctcccagcatccattgtcaccgtgtctttgatctggtgggagcaaggggcaggaagagggagaggttgctgagcctcatggaccaggagcgcctcccaccagtgcgggggccaaggctgaggctctagggagctggatggagggaaacacggagcccatcgcagcacaccccatacccccagtgactgcaccccacagccacggtcctattaaccagcaccccctagcccccgccatgtctgtgatcctataatctggcatactgagttatttttaaagacaaaaatacaccagtattcctgctggtgaagtgctgtgtatctcagttcatttaaaaagctgaaatccaaagcatttgcatcttgacacatccctagagagttatatgctccactaaaatttcaagtcaaactcttagtagcactcatatgaaaaccccctccacacctctataatccttagacaacacagggaaatgacggatgacaaagcaagtgtttactgcaagaataactcctcctcccgcttgaggctttccaaacatgcaaaagagaagcacgacagcagaggcgctgatgacactggtgtccccgccccgagactctccacccccaagtgctaggacacaggaagacacacacgcacaggaagaaagcttccgttccctctaaagatcattctccagacagcaggagacagcagcctctacaaaaatgtgttcagaaagatctcagacgtagaaaacaagagaagagaatgaagttgacaagaaaacacctggagtcagttgataattcccctcatctctgaaaacagaggcagaggagctgaaaaataatttgcacaaaaaggaccatcaaaactcgagggtgacagtgcagtggcaggctttcctcagacctcacggtttctgggggtcattcaaatcatttcagttttgatttttttttcagctttacatggtatgctgtgtttgtttagtttgctattttcaaaaaaaaaaatccttcttaaattttcattttaaaaagaattatttgggggcagggtacagtggctcacacctgtaatcccagcactttgggaggccaaggcaggcagatcacatgagatcaggagtttgagaccagcctgaccaacatggtaaaaccccatctctactaaaactacaaaaattagccagacatggtggcatgtgcctgtggtcccagctacatgggagactgaggcaggagaattgcttgaacttgggagactgaggtctcagtgagcccagatggcgccactgcactccagcctggacaacagagggagactcggtctcaaaaaaaaaaaaaaaaaaaaaaaaaaagtgtattaatttagtcaagaatttatgataaacaatactttgaaaaatttacattatatttgctgttttacaatatatttatggatagttttagagctgacacgttaccacgtggattccctgaaaggtttctccatggtgctctagatgagcatctaggagggaggccccaggtgcagacaggacgacaggcagcgcaggaggtgggcagctcccccagcccacagctcccttcctttccctgggccccacaccattgctggtatccaaaatgaattcatccccaaaatactgcttccttataaggaatacaagaagtactatacttagttttagtgagaggggagagggaaatgaggtaccttaaacaaatggtaaaatttggaagcccagaggacccaagtgacggactgactgattctgattacactggtgaggaaccgcaggatctagaagtgactcgccagggctcccccatcctgcagagctgatcagtactggctcctctaccccaggctgcctcggcatcagatgtcagtctgagtctgctctaaaagcgccacctgcagtctctttcttcctgtgctgggtgaacaaaggcgtgggaagagatgggctagtcttcacaagacacttgccagacccaggcatgaggccagtgagaaaggcctatgggctgcaacccagccccagagggccagagcccactcgagagtcccaggggaggatggggcccgagtgtggagtggtgcccctgagcagatggctctcgggtgagggcacctccctctgcttcctgggaagcttctcttgctacaacagccctctgcctctaagttctggaaaggccactgctgccttgccttgtcccctggcactgtccagtctatccaccacagctgagctcagctcctcaagcaggacctgtagctgcatgtgtaactgcattcagggcagcagacggcaggagcatggggggctgcccttctacagacggaactcggtgagcagggcccgtctaggaaagtgcgttggaacctgggagatttctgcaacagacagcagtggcctacagcttccagtggtgccgacctcaactccccaggcagttcctccctcctcctgggagcaatgagacttccccggacaaggtcagctactggcctgaggcaggagggcggccttaggggagctcccgaggatatctctcccctgggagctgggaagaagaaggcgagggaggcaagggcacagccaacctggcaaagatcctgacaggcccccggcctccccatgctacctctttgctccctctttgcctcagcccactcagaacacagaagggagagagggcatagagaaggaaaggggaaaatggagcaagacgtgcagatagaagacagaagcgtgcaagcacgatgccagaaactgaagcccagccctcgggctgagcaagatgaagatggctctgcggtgagggagctagacctgccagaaggccccccacagctgacccctgacaggcagcagccagtggggtggcggggccaatccccagggtgcctcactgcccacccctcctggtctgctcttgccggtggagagtgctctcttatccatgaagccagaccaacttgagaaggagctgaggatttcagctctcagagctgatggggcagccgcgggggctctctcctgcctgctgactcggaacagggcctggaaaagatccctgcctcagctgacaggtgcacttgatgcccagtcaacaccccctgtggaggatggaggcgggctccaggctgaatggctcgcctgagtgctgggaatgcggtggttgccgcaaggacgtcaggcctggaggtctcattgctggacgccagcaccacagggaactcaggtgttctttgtgcatctctgtgctttctatatttctacaaacagtcttcacgattaacttcaaagatctcaaaacttggccaggcgcagtggttcaggcctgtaatcctagcactttgggaggccaaggtgggtggatcacctgaggtcaggaattcgagactagcctggccaacagagcgaaaccccgtctctactaaaaatacaaaaattagctgggcgtactggcaagtgtctataatcccagctactcaggaggctgaggcaagaggatcgctggaacccggcaggtggaggttgtagtgagccgagatcgtgccacttcactccagcctgggcaaaagagggaaaccacatctcaaaaaaagaaagaaagaaaaaagaaaatctcaaaactccatccacacgggctcgctgttattccccaggcgtgtgtctgacattctgtgacatttcagagcagttactgactcggtcattttccaagtttccttcttcatcattttgttttccttatttgatattgacattttccccaaaaaattatgtgctcagataccaggatgtgaacatgagttcacggtttttctaggatgattaccaaattctaatgcattatctttacttattaaaaatttattctaataagcttttcaaaaatttcattgcagtaaatatttctcttcacactggcttttgcctcaagggtctggagaagtcttggtggttccttgtatgaaattcccattacttggctggcccatttttacccacagaaacagtttaatgaggttcaccctaatcctaacagaggagtaagattcagacgggcataataatgaatgcccatctcaactcactgttgctttgtgcaggcacaatgatgtattttctatattgaatcatttgttcatcatgaccaccattccattgtgcaaatgaagaaactaaggctggctgggtgcaggggctcacgcctgtaatcctagcactttgggaggctgaggcaggaggatcgcttgagcccaggagtttaagaccagcctgggcaacatagtgagaccgcatcactacaaaaaaattaagaattagctgggtgagctggtgctcgcctatagtcccagctacttggggggtctgaggtgggagcatcacttgagcccaagaggtcgagattacagtgagctatgattgtgccactgcactccagcctggggaacagagaggctgtctcaataaaaaaataaaaaataaattaaaaatagaaactgaggcccagaggccaggcacagtggctcaccaggcggtgaattatacttgtaatcccagtactttgggaggccgaggcggaaggatcgcttgagtccaggagttcgagaccagcctggccaacatggcaaagccacgtctctagtaaaaatacaaaaaattagccgggcgtggtggcacatgcctgtaatcccagctacttgggaggctgaggcacgagaattgcttgaacccaggaggtagaggttgcagtgagccgagattgcgccactgcacttcaggctgggcaacacgagactcagtctcataaaaaaaaagaaagaaagaaacggaggcctagagaggttcgagaccacatgactgaggagggccatctcccagcaaggggcctgtgtctcatgcattccccacatcccctaccactgcccaggcctgacgaggagttgctgtcggttgaaagacatgctggtcaccccctgggcatcacctgcctcacacttggtacagcaggacctggtagtaatgatccaatgcataccagccctgccaatctgcctgacctttaaacgccttgctttttgcttctcataaaccacctttgaaagctgcattctaactgacctgcacagaaaggcagaatagagggatgtgaatatctgagaactattctgataggaaaaaaatctgctgtgatcaagtctagaagctctaatcagagccacacacaacacagactgaagggaatctccatgggcccatccaagcccccgcagggctcagctagacctagggcaaggagctccgcgatgaggagaggttgacaggtaggaaggagacagaaaatccacattggccacccaggagttgagctaggtggcccaatctagtgctaccaaacatcccagccccccaaccctggaggtgtggcccccagagagcaaggctttaggagaagaatgttgggctcagcctactagcacatcttcccagcaggagcctgaaatactttttcaagagcagactcgtgagatgcacactgctggtgaaaaagggcccctgagggtgctcttccagacacaagaggcctaacgtatctatggctttgggaacttggccttggtatcttgcttcataataagcaagtccttgagatatcactgacttcagcatgggactgatctgcaattacgtagcaatgggtttgggtgtgagtgttggtgtgtaagctccgggcagccatgactgtgtctgggtctccctcccgccttgtcccctgtaatccagactagagctgggcattaagcatgagctcaggcagtgtctgataacccagcttgcacttaggcctccagtgagaagccatttactccaactcaggaggcttctaatccggacaccacgcactctgcagcccctcttcccgggatgctgtaggagaggctgaaagccagccaccggcccacccacctacctgccgcagcgcctccatctcctcattggccgccttcttctcagatgtgctgctcttgagcttggactcggccagctccacttcggtctgcagcttgtccagctcagagatgacctggtcacgctcactcatgatgagcttgtactcgctgtacacagcgtcccgctcctccctgtatttctccgactcctttgctgtcttcacctgcgtggttctcagctcggtcagctctgactgcagcagctccatctcccactgcaggtccttgttctgcgccgtggccttgttcagctcatggtggatcgcctcaaacctggcaagagaggtggcgagatgtgggaagggcgggggccctgcccggtcagtggccggctgcgctgctgcctcccgccagctctactgtgctggacagtcaagcgtgaagtttcaagtgaagtcactctctccacccccaggagagaaaagtcatggagtaccagtgcccccggacctggaatttttctcagccctttacaaatgccaggagttgaactgaggacttcatgccctccactccactagaaacaacagcatatttctcccacagtcaagccacattaattttttaaaataataaaaacaaaacaatgccaggataacagcataaagaggccttaacgatcatttagtcaaaccgcctcatttcacagatacgaacagtacagccctgtgacaaggtcatcaagttcgctcgaagagcacagctctgtccttccaggccgggggacatcttccacacaggcagcctgcaaatcagagcccatggctccagaccagcaattctcagtgtgctccatagacaccggttctgcatggagctccattacccccaaaaaagtatattatctgatgacttatgtttgggaaactctgcatcttggccccctcttggagagtctgtctactgcacaacaccacgctgaaggctctgagaagtcctgcagcagagacatctgtctgggttcaacctggcaatgctcaaacctatttatccccaaagagcacttttcatgtgaaactgctacatgccccagagaactggtgattcacaggcacatcctctacaaaacactgtttgagggcatatatcacatctctaaagatgacagaagacacatgccccagataattaactttcctatttgctaggtgggtgactgccacagaggggagaggcacatgacagtgaccaaagaaacaggatgctcagaacacaccagtatttattaagtattgtgcagagcagttaacacagcagacccgagatttctacacgctcagaaaggcccgcttgcaaggctaaccactgaatggtgtccgtgaacccgaaggtaaacagggatgttcagatgggaagagggagccacgattcccaagacacattcagtgtcaaaaaaaaatgtttcctggtcagaagcattttttgattgaaaaagcacaataactcatgctgttctcatcccctggtggtggctgggaaccttataggacccatttgcccccggcccccgatggccctagccctacctcctcagggagagggcgcactggtgctgcagctggatggccgtgtccctctgctgggtcagcatctctgtctgcttcagcaaccgctggttctcctcccccagctgctccaggcggctcaggtctgcattgtggatggcgactttctcactgtacctcttccgaagggcgtcatagtccttcttgaccacctccaacttgtccatggccgtgtcatacagtttgttgagaatctcggatgacccgttgtgcttcaacacctggagaccagacagtttcacttaccaagggtctgtgggaggtggcggaggagacctcccactctcacttttgtctatctgagggtgagactgatgacaaggcggttggggggagggggttaccctaaagcttttgagagtcttgaggtccaattctccaggccctgcagtcacactgggctgattcatttagattcactcagtcacaactatttactaagtattgtgcagaacagttaacacagctgacctgagacttctatatccttagaaaggcctgcttgcaaggttgaccctaccgaatggcgtctaggaacccgaacagtaaacagttctctaggctgatgtaaaacttttcttctggtgatataagcagctctggtactgagcctgtacaaataaagtggcttatgctgaacacctgctttctactgggagtccagaatctgggtacatggcaggcagaagttcctacatgaccagcccccaataagacacttgagcactgagtctctaatgggcctccgtggaggccagcacttcttgtgtgttgttgtgattccatgctggaggaattaagtgcctccggtgaaactccaccaggagaggattcttggaaactcaggcccagtttcccctggactttgcctcacgcgcctttccccctttgccgactttgctctgtgtacttttgttgtaataaatgtcagccattgagtataattacatactgaatcttttgagtcctcccagaaagtgacatagcccagaatcaggttatgtaaatcggacctaaagactctcaaaagccctagggtgaccctccatggtgtagggtccccccgcatcccatgcaagtacctaatatgtctagcactggtctaggggctggtgatgccagacaggacagaaagacgctgtgccctgtgggccttttatcctaatttggagggtgtggacacacagataggccaaataaagtaacttcagagcaaggtaagaactatcaagaaaataaaaaataaaacagaataatgggctggagagagccatctgagcagcagagtggaggtctgtgagggaggctaaggctgaagaggcttcttgaagaaggcgacttcagaggcaaatgaagaagagcagcgagagcacactgggcagagaggggggcagggtcaaaggcccagaggcagggcctgcaggcgtgttctagagacagagaggggcaaggcggagtagcaagagcccaatgcacagggggaggtgggttcaaaggggacctggagaagtgggtgtgggcatgggggtggccatggccgcaggcctcacagtgaagactgtctcctgagtgagacaggaagctgtggagggttttaagctagacagcattctactctaaatgacaggcactaaagttcatttggggtgctgttatagagaaaaaaacaaaccaagaagatgagttaagaggttgccaggggggctgctggctttggctaagcacctcatgggatctgagccctggggtgagtcactccacctctctgggtttcagcttccggattcctcaaatgcccaggctagaccaggaaagcttgtctggcccttccagctccaacagccgaggaatcacctggctcattcagtggcagcctggtttatcaagcgtttgcagcctagagaaccagaagctgggacgatggaacactccctttggaattagggtcagctctcaataaacacgaaaaacacaaaaagcaaaagagggcttaatttaaaagtcagaatcatagcaacaagaaagtaaggtcttcctctaagacctaagcattagattctaggactgtagactcttaaagaggaagtcaaggaagagggagaaatggagggaaggagggaagaagggaaggaaggaaggaaggggaggagaaagagaaagagagagaaagaaagggaaaggagggagggagagagggagggaggattggttcatttcaggctcattctttttcctttatttatttttaaagcagaacattttctttcaagggaaatcttactagtacaccaaaaatacagaacttattttaaaaagcagtacacaggtatctcaggcagtcaaaatcttcactgttttgtaaaatggcatcactgttgcaaaacaggaatgcacactgagaaacagaacctcactgacagtgcccactctacatctaaaatctttctttaaaaaaaaaaaaaaaaaaaaaaagccctggccaggcacagtggcacatgcctgtaatcccagcactttgggaagccgaggtaggcggatcacctgaggtcaggagtttgagaccagcctgaccaacatggtgaaaccttgtctctactaaacatacaaaaattagctgggcgtggtggcgggcacctgtaatcccagctactcgggaggctgaggcaggagaattgcttgaacccaggatgcggaggtggcagtgagccgagatcacgccatggcactccagcctgggtgacaagcgcgagacttcgtctcaaaaaaaagacgaagaatgggctcaccatgactatactgggtcagtgaaggacagtcctgacatctggtcaaccaacgccttctacccacatctggaaaggtccagcatctaaactggattgccctgattggtgagcaatacctcaaaaatgccaattaaaaattacttcaggccgggcgcagtggctcacgcctgtaatcccagcactttgggaggccgaggtgagcagatcacaagattggaagttccagaccagcctggctaacatggtgaaaccctgtctctactaaaaatacaaaaattagccgggtgtggtggcaggcacctggaatccctgctactccggaggctgaggcaggagaattacttgaacccaggaggcgtaggttgcagtgagccaagactgtgccactgcaccccagccttggcgacagagaaatattctgtctcaaaaaaaaaaattacctcaaatgttttactgtctaaacatcccctaagccaagtgagaaccccattggctccaaatgagtctgctttgctggggaacaaaggaggctgtcattgcctgagttccccacaaggtggcagccgcggggagacgagccaacgctctcctgcagcggcttcccgccttcccagctcagaaacaaactcattccaaaggcagccttgaaatgacacaaagcccggttctgggtggtagcccgcagagcccacctccacaagtgctcggcagaatcaggagtctataccatggtttggcctctttgcagtcccctgaatggctaaccttgaggggcctggatccgggcctgtgtgacaatccagggatgattcagggccgtgtgaatcaggctgccagcaagggccgtgagagtgggccacgaattcccagtgcgacagggtgggtcacagacctcgaggtcctttcagctgctccccccagccttcataacatggtaggatcctcgggtcagaagaccgagagagagagatcaggccccgtactgcttgcttccaccacgatgacggccaccctcggcctgctccacaagtgaaagctccttgggatagggtcgtgctcaccgggagctactccgcctccctgcaactcctaacctctggttctcactctagccttggagtcaaacagaataacctgttcccacagggcagcatccagatactcaaagaggctcgcaggccccaaacacttctcaccctttctctacaaacaggactcagtgccaggcctgtactatgtaaccaacagcctctgaacaaagctggggaaccaggtcatggttaactccggagaatccaaaaaactaaatctattggtctagaatttttccctctcgccatcagaggattatgttcttggtaggtatttccacatgcacatgcacacacgagtgcgcacacacacacacacacctaactacagtcaaatgtttagcttcccagcaaaagctaatgaagagagaatatttaaatttggcccagaattctaaaattaaagtgatcacagttcactgcaacctcaacctcccaggctcaagtgatcctcctgcctccgcctcccaagtagctgggaccacagacacgccccaccacacctggctgattttttattttttgtagagatgggggtctcactatgttgcccaggctggtcttgaactcctagactcaagtgatacacccactttggcttcccaaagtgctaagattacaggcgtgagccctgagcctggcctgagagtcaacttttccactcaggcaggcagcagtctttagagatgatgtccctccagcctgagcacgggacagttggcctgtgagttcaaggggcttaggagaaatgggtggaagttgcacaggggaggcacaaagacagccacagtctaagctgttccctgcagggaggccaggaagagaccaaccctcctacctgtaccctacattggtcagaacactcctctgtgggcttctctgtaagggatgcccttcagcaaccaggaaacccctctcctctcttccttcctccaggcccatcaaagggcattcattcaggatacctgggacaagaaaatcaactttcatgaattacaagagaaagtatattttaaagacaggggaaagggcaaggaggaggagagagaagactctcggggcctgagaggtttcccaaatagattagcaggacctaggagaacatgtgcactgccctggtcccaggaattctacctgtaaggctcaaacttcaaaacatgtgtgcaaaagaacacaaagacatgtgtgtccactgaaacatggtttgtaacatgggaagatgttgaccaccaagacgctccacacagaattcgattaacacctgacagacaacaaaacaagcaaggacctttttgtatgtgcaaattcacagaaaatgtaaggaaacccatgatatattgtaggatttttttttaaagcaggtttcagggaataaaaattaaactatatgggtattaaatgtgacattaaaaaaaaaatctacaaggatacacatccatcccaatggtttacacagaggatggtcatttccacaaagctaggctggatctgagtaggtgggtggctgcccacattggttgaagattttttttctattttaactaaagaatacacactattttagtaaagaaaaaagatgcaaaaacaccctctacttagattccccaaccaagccttgtcagggtcttctgggcattcttgacacagcctagaagaatccaagaaggtgcactcggactgcccaaacccagagatggggatgccaggcagaggccctccccagcaaaacacacatatggacaaaacacctgtgtgctgctctcaaccatggcgccccctcccctagggctgcctcatttcctctgagataaatcatgcagagggccgggaagccccacaaatccctcaagcaaacactcaagtcaaacagcaccatttaccctgcaagggcctcttcaagtttacaaggcgtgggaggaacccggcaacaaaactgcccttgtccagagaggttgacctttgcccttgggcccagcggggagcaagcctgtggccatccccttatccccgcttcctctgctgctggcctactgccacctgagcatcccacagccaggcatccactccacgcctgatgaaggcaagggggcccaggatgccaggacgcggggctggtcgcccagcagctctgagatgctcccagccctgctccctgtggcagccaggcctcttctcctggtggggtctggaggtggtgtttgctgagaggcactggtccagctgaactgacctgggggaccccaatgaccaggatgcatccccacccccgcccctgctgccaaggaccacaacggtaggaaaaggagagcagggaatgggctgcaaggtgggggaagaagaccctcccctgtgaggcagacaggaaagggagagggggacaggggtgggagggagacctcagtctgaatgtctgtaaagctgagcaggtgctcaagaaagtcagagaacgggagacaaggaaactttacgcttcttgagggcagagtgctccttctaaaaaaataatattttcaattaaacaatttcttgtagagatagtctatgttgcccaggctgatcttggactcctggaatcaagggatcctcctgctccttccaaagtgctgggattacaggtgtgagccactgtacccagactggatttctctatttatgacaaggtgaaattctgagtctttttttttcctctctgagttataatttacataccacacaaagtatgcaattcagtgtttaatatattcacaaggttatgaatccacaaagttgtgcagccactaccactatctaattccagaacatttttatcaccccaaaaagaaaccaatacccatcagcagtcacttcccaaaccccaagcccaagacagccacaaatctgctttgtgtctacatagatttccctgttgtggacatttcatgtacctggaatcatagtttgtggtctttttgctggtttctttcattggctgtcatgtttttgaagttcatccacactatagcatggatcagtactgcattccttgttatgctgaataatattccattgtatggatagatcacattttatttatccattcatcggtcagtagacctttgggttgttaccggttttgggctgctatgaatattcacacctcaagtttctgtgtggacgtatattttcagttctcctggacacctaggagtgtcgctgggaggtcacctgttagctctgtttagttttttgaggaatcactaggctgcctttcacagtggctgtatcatttattcccaccaacaacatatgcaggtcccaatttctacacatcctggatgaggcagatttaaacccagacttgacaggattagaataatatcattaacgaccacaacactgactgagcgcctcatacacacgggcacgcggcgccagtgccttctacgcagtgtcttcatgacagccatacagaccaattctcctacactgagatgtgccaacctcgtgctttctagcaaggctgtggggcttcccttggaccgaggtggagccacatacacctctgaaatgatgattctctcaaggaagtatagaatccaaactaaaccccaaggcaaaaggttacctgagccaagcgtagaccaagaagaacaaactgccggcaggcaaaacagcaagaaaacaaagcacacagcagggtgtaggtaaaggccgggagaggccgcctgccctcaggtgggggaagttaccacgcaccccagggcagagaaggggctcaaacccttagagggccatcccctcgggcagcttcctgggagctttgttttgacacagcaccgccatccttacctgcttcacacgcaagattcctccacaggatttcttttgaggttaaaaatatttttgcctctttagaaactgaaaacctacagtctttaaatctgtttgctccaggaagctccactgacatgcacaaggaagggtccctgcagggggaatgggttgtgggcagtactgaccagagctagcacggcactttctactctctcatttcatccttagagaaatgctccaagagcaccacccccacctcctgaatctataaagggtgggaagcatgttgtcacagcttctctgtgccatgcagcaggtgcgagaagggacagtcttcctgctgccggctttccattaccaaggctcagtcaagacctatgggctaaataccaacttttgccccagccactgggcctgacctcacacgaccaattcccctaatcagagggcacataaaaaatacttctaatagctccaagtatatccatcttagggtctcttgctgagcctgccctggttactccacataaaacctcaatcaatatcggagaaaggaaaataaacagcaactttttcaacagaagcaagtttttcaatggaatacagtttcattggaatatggaatactccttttatctaaacaattaaaccttaaagccattaggcaaagcagagcaagacaaggacctacactagggcaggtcgccccagaggggatatcacagctggcatggaaagaggagtgggtcctggcatggcatgaggagaccaggcctgacagagagaaggcatggggtggaagagcccacaaagggtcaggaggagatgggaacaggatgggggactgcagagggcatgggaggcagctacacatgggggattgaccaagtaaacaaattaagaataacaggaattggctgggtgtgatgactcacacctgtaatcccagcactttgggaggccaaggtgggtggatcatgaggtcaggagatcgagaccatcctggacaacatggtgaaaccctctctctactaaaaatacaaaaatcagccgggtatggtggcatgtgcctgtagtcccagctactaaggaggctgaggcaggagaatcacttgaacccaggacgcagaggttgcagtgagccaaaatcacactactgcactccagcctgggcgacagagcgaactctgtctcaaaaaaaataaataaataaaataacaggaatcacatttgtcactgtttgtttgtttgtttgtttgaggcagaatcttgctctgtcacccaggctggagtgcagtggcgcaatcttggctcaccgcatgctctgcctgccgggttcacgccattctcctgcctcagcctcccaagtagctgggactacaggtgcccaccaccacgcccggctaattttttgtatttttagtagagatggggtttcgccatgttaggatggtctcgatctcctgacctcgtgatctgcctgcctcggcctcccaaagtgctgggattacaggcgtgagccaccgcacccagccttgtcactgatgtttttaaaggaagttacaaaaataaaagaggtggaaaccaaaatgaacctgtggtcttggattagaattgaaaatgtcaatgcgaactcatggctttcaatctacctgtctgatatagaaatacagatatacatatgtgtatgtatgtatgtatatgtgcctgtgtgtatgtgtacacttagctactccctacttctttccactaagagggccgggaaacagtgccaacccaagctacaagcacatccagcaattggttggctgtgttttttttatcagagacagcgtctcactccttcgcccaagctggggtgcagtggcatgatcatagctcactataacctcagattcctgggctccaatgatcctcctgcctcaacctcctgagtagctaggactacaggtgtgccaccatgtccagctaattttttttttttttttgtagagatgggatcttgccatgttgcccaggctcatctcaagcaatctctcaccttggtcttccaaagcgctgggatcacagatgtgagccaacgtgcccggcccagcatttacttctcaatactattctccattaaaaggaatgaggactacttgggagaaatggccagtctccaggggctgggcctacctgctgctgctgggcacggaggtcaccgatctccttctggtcctcctcgtggagccgcttcatgtcctcccatgactgctgcagcaggtttcgctcccgcagcagctgcccattctcccgcctcagcatgtccacgtcatccttcagccgagtctggtcactcaggagccggctgtggagtgtgctgaaacacccggtacatgctcagtgagccccagccagcccctcacaccccgccccaccccagggcatcaccagcctcaggtcccaacacttcccgtagatacagcggacaggagccaatggcaggtaggtctgtagcactcagaggcaagccaaaacctgctaacagcccaattccagaaacatccaaatcaccacttacaaacctgacaccaaaaagggcacatgtatctccagggaagggagacaggcccctctggtacagacctagtgcctccaaatactggggcctggacagatatcagcaggtgggcaggcaaagaccctcagagggatgctgggagaccaaagggaaacaccccttgggcctaccctacaggaagaagctgcagtagggcccctggacagagacccagaggcctgcctgagccctgctgcatgttctgaatcactttcatgcctgccaggtctctgaagctggcaataagatgtgaaggattaatagccttgttttacacttaggaaaactgaggcccaaaggcacaaatccacctgctgtaggcagactgcttgctcttgcacagggacaggactagaaccagaacccctggctactaagtccagagaaaagaagggcaaaggcagctgtctgtgggtgttggaggccctggccaagcaggcctcactcactggtagaagtcagtctccttggccacctcctcacacctcttcaaggcgttggtgtgctggttctgcaggctctgcaggtccgacatggctcgcacgcactggatcttcagcctctcatagtcaggattcagcctgtggtagggcctggcccagagagcgaatggccccatgaacacaggccccaggattcacacggatagaggaaccaggtcctggattaggccagcccagtggttccccagtactggtcttctatgcaccacacacacctgggtgtttgttaaactcagatatcctggcctcactcagacccacagaatcagaatccctaggatggagggagccgtggttgcctgagctccctgcatgggcctggagagctaagaaggtgccaacttgttctgcaggagcttccaggagtctgtacaacaggtctgagtccaccagaaacctgtgatgaaatgtctcttctctgtaggctcggcgtgacagctcgtgcctgtaatcccagcactttgggaggctgaggcaggtggatcacttgaagccaggggtttgagaccagcctgagcaacatggtgaaaccccgcctccacaaaaaaaaatacaaaaattagcctggtgtggtggcatgtgcctgtagtcccagctactcaggaggctaacgtgggaggatcacttgagcccaggaggtcgaggatgcagtgagccgagatcacaccactgcactccagcctgggcaacagagaggatcctgtctcaaaaataattactaaataaataaataaataaataaaagtaaaatattaaagaaaagaaatttctcctctctttagaacaatgactctcaatcttgggtacacattaaaataccaatgcccaggtcaattacattagcatatctgaggataaaacccaaacgtgaggattttttaaaaactccccagggtattccaatgtgcaaccaaggttaagaacactggccatgagcagtgatctcagagtggggttcccagacctgcagcacagtatcacctgggaacttgtcacaaatagacattctcaggcctagccccagccccagccctcctgagtcaggtgttctgaagggagggaaagagaggcaatgatctgtgcattaacaagctctgtggatgattctggtgcatgctcaagtttgaggaccctttttctagagcagaggtcagcaaactttttttgcaaaaggccacacagtaaatactttaggctttgcacactacatagtttctgttgcaaccactcgactccacctttgtagcaggaaagcagtcatagacactttgtaaccaatgagcatggctgtgttccaataaaacttcatttataaaacaggcagtgggcccgtgggccatagtgtgccaactctcatgtgctagcacatccacgtcttcactcatcctgccttcgggccaactgactgaggggcatatcctcatgaatacaagctcagggatcaggctctgcagctctggcataatcccagaggcacaaagtgcagaggcatagacccttactcctgaaggaaagaggtgaaactgaagtgtttacaccaagcccccctcccctccagacctctaccagcatgggagctaaaggataaaccactctctggccctcctccttcccagaaagtcctcttagatcatgcaggtagataaagactctctctgccccaccctatgggccacccttccctggtatctacctctaaatcacaacaaaagcagcaaacattttcttcaaagcaacaaagacaccaggtacaatgtgctctgtttaaaacacatcatgtggggccagacactgtggctcacgcctgtaattccagcactctgggaggccaaggcaggaggatcactggagcctagaagcccaagaccagcctgggcaaaaaagaaagaccctgctgctacaaaaaaattaaaaaaaaaaaattagttgggcatggtggcacacacctatagtcccagctacttggaaggctgaggtgggaggttcacttgagccggggaggtcaaaactgcattgaaccatgattgtgccactgcattctagcccaggcaacagagcaagaccccgtctcaaaaaacaaataaaacacatgtgtgacagggaacaattaatatgtttaccaaccacataaagcttcactcaacttaggcaggtctaggagacagtggtagggacacacacacacacacacacacacacgagctgactttgcacacaagcacaccactatcaggggccttgccacatgtgggatggggacctgccccacaagaagcctgtgggtcctgcccctgggaagcatttctggacatgaggtgggggaaaggggacactcaggcagcgcagcctggacccccaggagccaggggtgtttgggggtgacagcaccagcatcggggtagtaatcccaaccatggggcctgggcaggggagacggcgcaattactacctcttgtcaaaggccgtgccatgcgtagcaaaggccaggcgcttgcggagctcgtttctctcccgggtcatcagccgcagctgaatggagaggttctccaccttctcattcacttgctggtcagtgaggaggggtggtggggacggcgccttcccggtagtgcctgtggaaggggaataataaagtgaacttgtgttcatctggcattcacgaggcgcccggtgctgtcctgagctgttggcttgtgttagctattcgtgacccaacaagtgggtcctcttagcattcccctttcacagatgagaacactgagccacagacggtagcaggtagaactgaaagtgagtgcagggcatctggctccagcatccaagcactcaacaacccccagtaaccaccccagcaaggaccctgaagacgcgcactctctccccaacctggctttcacacctccaggatgcgactgttttggccgtgatccttgcatcctcccctggtttggaaatatcagctgttacccaccactaagcctggcacatggagcaggacagaccaacctgtgccctgaggagagtggaaggcatggctcgaggagaaaggcacacctgaaatccaatgacgctactaaggaccagggcagctggggcccaagggccgtgtccccgccctcctcgaccagggctggacagtgcacggctccctttttgcaagccgtccacccgcctgaaagacctgcccaaccagcccaggcgtgcaggctaagaggagggctgctggctcccagctgaggtcagtgtgacgcaattcaagttggtcctgatgcctccaggctacttaaccctcaccagccctcatcaaccaccctaggactgagtgtcctacagggagccccacaccttatgctcctagcaggcaacagccaccgctgccaccaccacctctgataagatccaaatccatctctaggaagaaagcacctcatcccaggagaagagactaatccatggtgcttttatattgaaccctgtcaatatgtctacctgatatctcaatcaacccttagagacccttgttggggtcagaggagctcacagcaaccatccaatttgtggatgggatctggcaggctgactcgtgtcaggggacacagtgtctgttccgcactggacccacaacgcacaaagggcataggacatgataggtcttctgattctctgtgctgtcctgaccacccctgtcccactgatccttgttggtcaaatgttcatgcaaaccaagagtcccccaacccaagacaaaagcagtggcttggggccttccagaagggccagggaggatagggagctcagggccaggcatgacaagccagaccacagtgggaggaggatcctcaactcccagtgctgtgcttttcagtcttttcaggttgtggaaccccaaccacttgactccagcaccccctgaaatgcacgacagtcatgtgccacataacaacgtttcagtcaatgatggtggaccacatgtaggatgtggtcccataagattataatagagttagaaacaaaagaaatatgtattaaaaaaaaaagattaaatcacatctctacaaaaaatacaaaaattagccaagagtggtggctcatgcctgtaatccaagcactctgggaggccaaggcagacggatcccttgagctcaggagtttgagaccagcctgggcaacatggcgaaaccccgtctctagcaaaaaataccaaaaaattagctgggtgtggtggcacgtgcctagagtcacagctacttgggaggctgaggtgggaggatcgcctgagcccaggacgtcaaggctgcagtgagccgagatcacaccactgtattccagcctgggtgacaaagcaagaacttctctctaaaaaaaataaattaaaagattaccatggagatgaaaaattcctgtcacctaatgacgtcttgttgatcctgaccctctgtagccctaggctaatatatgaatatatttgtgtcttagtttttaacaaaaaaagtacaaaaaaattaaacatttttaaaatagaaaaagcctatagaataaggatataaagaaagaaaatattcagctgtacaatgtgtttgtgtgtattctttttgtgtgtgtgtgtttttttgagacagggtcttgttgtcacccaggctggagtacagtggcgcagtctcagctcactataacctctgcctcctgggctcaagcgatcctctcacctcggcctcctaagtagctgggactacaggcatgtgccaccacacccagctaatttttttgtattttttgttagagacggggtatcgctatgttgcccaggctggtctcaaacttctgagctcaagggatctgcctgccttggcctcccaaagtggtcggattacaggcgtgagccaccacacccggcccaatgtgtttgtgttttaagctaagtgttattacaaaacagtcaaaaagttaaaaaaatataaagtttataaagtaaaaaagttacagtaagcaacagtttactattgaagaaggaaaaatattttctgtaagtcgaatatagcctaagtgtacagtgtttacaaagcctacagcggtgtacagtcatgttttaggccctcacattctctctccactcactcactgacttacccagagtaacttcaggtcctgcaagctccattcatgtaagtgccctgtacaggtggaccattttttatcttttattctgtactgttgctgcagcttttcttttctatgtatagacacacaaatacttaccattgtgttacaactggctaccgtagccagtacagtaccatgctgtacaggtttgcagctcaggagcaacaggccatatcgtgtagcctaggtatggggtagataccatctaagtttgtgtaagcacactcatgtttacacaacaactaaattaccaaatgacaacgcatttctcagaatgtgtccctgtcattaagcaacacagactgtgtttaaaagccaccagcatcatgacagccaggatttctctgctccaggccgcacctttggggtcaaaatattctttggcggtgaggccaggggtcagcatttcctctccccaaaggggtctcctctgcagcttcgaagtcttcccacacctttccaccaaaagaccctgagcttcactgctgcccccagcagttttgtgggtcaggtgggtgatggtgctgagtcatctgactgaccataacctacctgactctccaacaagtggagcttcctttgaacgtgcctgctactcaacctctaaccaagcccagggggaggttatgttccaggcattgatttcaccttcacaacaacctcacaagtgtgtactgataacatcgtccccatttcacaggtgataaactgaggcccagcaaggttaggtaattgactcaagtgcccaggcagtctggattctaaacacatgcacttcaccctcatgcctcggtgcctcccaaataacaaccaccagtagcacacaatgcaagcctggcaggttttgggtttttttggttggttttgtttttttgagacagagtttcactcttgttgcccaggctggagtgcagtggcgcgatctcggctcaccgcaacctccacctcctgggttcaagcgattctcctgcctctgcctaccaagtagctgggattacaggcatgcgccaccatgcccggctaattttttgtatttagtagagatggagtttcaccatgttggccaggctggtctcaaactcctgacttcaggtgatccacccactcaccttggcctcccaaagtgctgggattacaggcgtgaggcactgcacccggccatgcctggcagtttttgaaatgcttttcatacattatcccatttcgatcctcataaggtaaatatcactgttatcctcattttgcacatcaggaaacacaatcttaccaaggttaaatagtgtgtccaggtcacagagctatggaatatggaatatggacctctaaatgatcctagaacccaaggtattaacctcaaaacttgcacatttttggatcttaggacctctgtacttatctggcactccaaagagctcttgttcacagatgttatgtctaataaaatttacaagattagaaattaaaaccaagaagaatttttaaatatttacttattttttaaaaaatcaaaactccattatatattgacataagattttttatgagacattaaccaccctttccattacaaaacaaagcaatgcggcaggaacagcatcattgctttgcattttgttacacaggctgtttaacatccagcttcacagagacagctggagtctcatctctgtaatgtcacacacccaggatggaatctttagaaaactagactctacacccatgtgaggatggaagcagaaaagaccagtgacatcctagtatcattatgaaaacagtctcacctcacgagccctctgaaaggacctcagggacatcaggccacactttcagaatggctattctatgctatagtcaagttcaagaaatagcagagaaacatcaaatgtccagtttcacaacagaaaagcaccaccaggcccagtaacctgcctttggggagacaagaaattttgaattttcatccccattgtataaacgaggcaacataaagatgcagccctggctttcaaagaagctggagagaggagaggaggcggcaggacagaaggaggggctcagagccatcccaacacaccccatctctgtctccagacgtctcagtctacagccatgaggacctgggcgtggctggccacacagataaagtagcaacgacatgtgccaagcactgcccaagcactgggttctgtgctaaagacactctaccttcaactcattaatctccacagctccctactggggttgtgctaggattgctccttgagaaacacgtcagaaagactacatggctaggaaaatgggattcccatgcacactcagctctgacgccaaagccaacacctcaaccactccacaacaatgcctcctaatagggaaggattctcgttccacttctcttggcccaaaggcttgagcatacaggacacatacagaaagtaaggtcaaccagacccaagatccatcacacatcaggctctcagacccagcagaaagtgcagccgatgcctccggccttttgtaattgggggatggggagggccaaggagggccacaggggacctcatgaccaatctcaagatgtgctacgcccagaagttccaaaagaacagcaagggttgcagaaaatcctctcaatccccattcaactgaagtttttgtctttttacttgcatctagaggttgacagatattctgaaaatgatgcagtcctaccatccaaatggttgtcaggatccctcaaatggccaccaagaccaaattctacagcaaaggagctcactacttcccagcagagcccatcttatctctctccctaaaattatgccctctactgagttaatctgtccctggacattccctccactgacccttgatctaacccctaagggccacagggaacaactggatttcttgtatgcaatagacctgcaagcatttgaagacaaccatgaagttcctttaccaccatatgcccatcagaatggctaaaataaaaagcaatgccaccaaatgctggcaaggatacagctggattctcaaaactggaattctcaaacactgctgatgagaatacaaagtcatgcagccacttcagaaaacagtttgacagtttcttataaagctaaacatgcaattgccataccacccagcaatcccattcttaggtattttacccaggagaaatgagaatttatgttcaaacaaaaaccagcacacagctgtttagagcagctagggaatgaataaacaactgtgttatgtccttatgatggagtattactcagcaatgaaaagggatgaatgactaatacaactgcggacacacacagggtgtgggggaagctggaatgccctgcgttaatcaaaagaagcctgactctaaaagctacatactacacaaccattcatatgacattctgggaagggcaacactacagggacagaaaagagatgagtggctgccaaggactgaaggtggggaaagggcagattgcaaaagtgcagagggaatttttaagatacagagggcagtgttttgcatcttaaaagtagcaatggttgcatgactatttgtcaaaacttgaactgtatacttacaaaaaatacattttactgtatgtaaattatatctcaatgaacataaccttaacaaaaaaaaatttcttttttgagacagggtcttgctctgtcacccaggctagagtgcagtgacacaatcaaggctcactacaacctccacctcctgggctcaagcaatcctcccacctcagcctcccaagcagctgggactacaggggtgtgctaccatgcctggctaattattattatttttatttattgtagcgacagggccccactatgttgcccaggctagtctcaaactcctgggctcaagcaatccttctgccttggcctcccaaagtgctgggattataggtttgagcaaccacacctagcctatttttttaagaaaaccaaactgtgatgccctgaatgaagccatcatcctaagagtgatgttgacaggtaaagagatgaggaccaacctcctctgctgtcactgtggttatttacagtaaactttttaaaaacaggcaaaacagaaactaacataaagctgggttgtcaacaaaagcctccaaagtagctgccaacaaaagcttccaatgcagttctaaccttgtgcagttgttcttctggactcaaatgcaaagctgtcaactctcccgtgacctcaggctttccttacccaagtctggcaaccactggagaaggaggcagattgtccttttccttttggtgttcaggatcagatttcagaggtaagggatttggtttggactaaaatggcccaaaacaggaagacaccagatcaggagcaggctctggatggagacaaagagcagccagccctgcgctgctcttttcacccccattttgtaaaggaggcaacaggaagacacagccctgccttacgaggaagctggaagaggagagaaggaagcaggacagaaggaaggggctcagagccgtcccaacacaacccatctcagtctccagccatgaggaccttggggcggccagcctccctctgacctgggtgtaagaaggagggcagaagggagtgtccccatcacaggaatcctcagctccttcagttgccctggctgctatggtcaccaccaccgaggctcagcaaatgaactggcagctgggtggatttctcagccaccgccctttgtcctgggctccctcactgtcatgctcccactgaccctggaggcgcatccttggtcttacagctgggcaggtctcacctttgcttccaggccctgtatgcctgtgcttccaggagccagagagatgtccaggtaaacttcctggccacctccaggccctggctgcccgggagaggcaaagcagtggcagagcacagtcatcagagcaccacgtcatcctcacctacaactcaggacacccagagccacagtcatcagagcaccacgtcatcctcacctacaactcaggacacccagagccgtccaggaaagacccaggccctgcctggggtgaacgagtgcttcttaaagcacctaagcttcactagagaacctgctaggcaaaatttcaggtcccacccagacccactgaatcagaaaccctgggagtaagtccctgcagcactccgtgtggtaaaagccctccgggtgattccgatgcctgctagagtttgagaacctctgttccagaccaaagttgcatttgcatatttctcctttgttttactggctatccagcagccactgcctttaaagaaatcccccactgatgtccttgacaatgaaggcctaagggggacacccctcttagtcaatgagtacatgactccagttcagcgtttccccagcttggagtgaaaggaggttagattccaatgctggaagcccaggccccagatctccagccagatcaaagacttgctttcgaacccttgactcagggtctggttttcagaacccaaaccaccataagcagccatggccaactacttcccagctgcatctagtccagagcacttttcctggaaggcccagtccaagggccacttcctccaggaagctttctgtgattcccctcatcagaactaactgcttcttcccttgagttacttctttctttctgctctacacagaacagaatagccagtcgtgccagacagtgcctgtctccctggcagtgtgataacatttggggccgtgttcaccgtgatccctatgagtaccaaacacctgccccacaaggaggaggcattcccatctctgataaattggctttgcaaaggattacccctgacccaaaagtctgggccaggaatgaaggatcagaggtcacagggcgtcagtggcagcccccacttccctgatggctcaccccaccttcccctgtcaaccagaagaagcactttcaaggaatcttccctgggatatgagagaagccctccagcaatttctcctgccgataagcctggagacctctccatttaataagaaatcttctgctatttcaatcttcatggaatttaaggctggctttataagtgctgcccaagaatgtctcttctcctccttaaaacctccccagttttccaagatgagaaataaaaggctactgagaaattaggtcaggatgaatggggaggaaaaaagtactgattgcctgaaacgagtgtgcagtccccaggcagatccaccaggtagggtcgggggcaggtcacaacaacaggcgcaggaagcgggggagggcctcggggaagctgtgtgtgcttagctgatgaaaactgcccgaggaggccttggcacaaagacctgctgcctttaaggctgttggcaaaggtgtggcgagttgtgagtagggccaggctggagatccgagacccgacagaccgcctgagagaacgctgtctacacgccccaggcttcagcctccaatttcttctcatgctgaatacaacctgccattgttttcccagccgtttccatttagggagatgtaaatggaaaagtggaagtgatgtttttattataaggatcttgctcttgccttttctcaggttcctaagatcaccatgtgaccttaccagcggcccctcctgccagggcggtgtgtgcttgcaaagacttctgcctctcatcaggtgtggctgagccagcaggaactccctggcaggtgctagagtgctcccagccagggccagccccaccaggcactccaccccgagggactggtacaagcctggtacagacattctggttcccttctcagggatgaggttgggccagcccatctcaaactggagggctattaagctgtagaaaccctcagcgtttctgatgcagcaggggtgggaggaggctcaaacctgcatctctaataagtgccccagtggtccagcgaccaggctttgtgagccactggtttcggcacaaacaagcagccaactgtggtcaatgaaaggaggccatactgatggactctggaacaggttcctttgctcataagaaccccgccttcttcttctgccactcaccgcagatggctacagagcacttgaaatgtggtggatttgcctgagaaactagaaatttaaatttcattttaattcatttaaatttaagtagccacctgtgtttagtggcgcccatactggacactgcagacctggacactgtcaggtctggatgtgatggctggagctgctgctacagacaccccgccatgagactgtgtgaagacaccacacagaggagggcagagctgcatccccatgtactggctgacctcagcacagcctcatatgggagctcatacatttcctgattggttaaggtggtatgagtgggtgttccctgctgcctgcacccaaaggacaatggcaatctcaagcagaagagcaagagaagcaaaactcggttccctgtgaactcaagaggctttgcccagaagggatgcaaccagttatttcagcattaaatatccagacacagacagtacagacccatcctgctccaagaaacacatcagagcactgcactctgcctgcctgtgatgcccaggaagagcacagagatactgttgacggctccatcgcaaggactgagtcagcttcaggtgagtgcagaaccaactggtgggtcacggccatgacgcttcttccagaatatgctggggtccagctgcccaagaaatatcttcctactcaggctgggaattccaccatcagcagtaattgctatgggttaggcaaatacccctctctggaatccccttttagaatgcacatgtgcctaggaaaggtaacgatttaacccttgaaatgccgatgggaatgagtttactgattgctatctgttagacagatattggtgaagggtgaaaaactagacaggtcagaggagtatgctcagggcttacccagtccaccttaaaaagcctcaccttccccatctactgatcctgactgccccactccatgcacttcctgaagggtgagtcccacattccaaattccaacaatcccatcattccattgatatgtctccgggcaccaaaagcaggcagaacaaagtaataggataccgttgggagctttgaattgcagtcccagaagggcctgccctgagccctaaacaggatgagggttatgggaggaactgtgtttttatgggtggagttgtggccccccaaaagatgctaaagtcccaatccagtaaatgtgaatgtgaaccttatttggaaaggtcaaagcgttatctttccgaggcgcatttgcattctaaaaggggagtcccgagagggacactgctcagcccacagcagttattgctgatggtgaaatagtctttacagatgatcaatttaagatgaggtcttgctgccgtaaggcaggctcctaggccaatctgaccagtgtccttattaaaaggggaaatttggagacagacacacatggacggagaacatcatgtgaacacaaaggcagagatcagtgtgatgtcggcaaaccaaggagcaccaaggattaccagcaagccaccagaagcgaggagagaggcccgggacagatctctccctagcgccttcagcctgcgtggcctcactgacactttgatcttgggcttctgtcctccagaactgtgagacaatcaatttctgctgtgtaagccacctggtctgcggcactttgttatagcagccctagaaaactaagatggaactcgccggctggtcactgtcttccctcttatcacactaccttcccttactgcagctacttatttaactgtttcccaccaaaagaccctaacatccaggagtgtggggcccacatctgcctaattcgccactacggcccaagcccacctctggcacactggaggtgttcaagatgtgagctgacatatgaaagagctgtcctgactagttctagaatctcaggcatgtgactccccctcccagaatgtcaatttccccatctctctgcagagggaaaagaaaataattggagtagatgacctctgtgagtccttcgggctcaaaagatggccgggactcaccactgaaggtgtctgcatccatcatggtcagatcaggccatgagaaaccccactagaggtgctaaacagagggaatgggtcacagaggtgtgggaagcctgagaaaccactgcggccttcctgctggacttcagagaagggctggcctcattttatgggctttctgaaacccatattcagagaaacacacccaattcagcatggactggcaatgcctatccccaaggaaactccaaaaggggtgagtctcctgggcagtggtcactgagttactacaaggcctttggggttggggtggggatggtgggtcaacaggctcccctagaagccctgtgccctgacaaagtaaacaatggcaaaacatgtgcttcccagcactcacctccccacctccttctaacatcagaactgggtttctgatgatgggagaaaatgtaaatgaaatcaacggaaggatgatcctgtgagtaatctgacaagggagaaccagcttcctctcccatgaaccccagctgccttggctttcacccagacccctggcccacccggtgtcctccccagacagtggtactcacccacactgctgagggagctgctgctttctgagtctgagggcatggtggacaggacgctgtaggtagaacctggggaaagaggggagaccatgttactaaccccaaggggtcactcgtcttcaccccaagccagctgatcatcagtcaatgccaggccatgagagctacatgcaccaggcactagaaatccacatccacgggccaagcagaggaggcgcgctcagcagatctggacttcggtgtttctgccaggcctcccacctcactttatcggcccctcctgctctgggcaggcgggcagaggggaacttggagtcagtcagctggcttcttgttgggacatctggggaaaggcttagcaagggagtgacatgccccaggtaaacatggggtgtgggggtttcctccacatctctagcaatatgattctggcttccatgcagagggtaacagagcagaaattaaagaacaactgaactatctgttctttctctgactgttctgctctttaggttctaactgtattcaagctcagttcttaataatttacttagtatctgcccccttattaaaagttactcctaaaatgatgagcaattgtaccatcaccaaagccagagggtagcacttttttttgtccacacttaatgttaattcctggttgtggacacacaaccactgtggtttggtttgaattcaaatatcttcaaaaccagatgttaccctcccagcaccgggaagcccagtttctgaacctagctctatgtaggtgcccatagctgggtcgtgctgagcaagtagcttttgttttctggaactctgtttcctggtctgcaaaatgaaggagttcaaccagatggcttataaggtccctaccccatcccccatcccccatcccccatcccatttcagcaatttccatgattaatggaaacagaaggtacactttgctcatcaagactatggatgacataaaattaaaagggagggcaaactgactcagagactaaattgggagtggacaaagcataacacacagagatggcaggtcagataaaacaaggacaaatccagtgttttgttcttggagccaaaagaactatacaatgaagagcggtatgtaccaggccaagtgggtgagctggagatggaatttttgcaataagggctttgaacaagccttagggctctggcatcagaaagctgccaagaactaatgagatcctgggctccacaacaagaaatgtggaggaccacatttaaggagctcccagcagggcacggtggctcacacctataatcccagtgctttgggaggccaaggtgggcagattgcttcagctcaggagtttgagaccagcctgggcaacatagtgaaactccatctctataaaaaatacaaaaaattagctgggcgtggtggcacgcacctgtaatcccagctacctgggagtctgaggtgggaggatcacctaagcccagggaagtcaaggctgcagtgagccatgatcatgccactgcacttcagcctgggcaacaaagtgagatcctgtctcagaaaaaaaaaacaaaaaacactcttccactgcaattcttgactagccaccctacacgcatctttggacgggaaagaggagaaatgaagaaatgggggtaaatgggggagcggggcaggggagggagatgcactgtaggtgggaggcccctgggggacaggagagaccttgaggggaaagcagggagactttgctggggaggtgaggaccatgcaggagggcagagagatagactgcaggcaggcgagctagcaggcgtgtccatcagaaaaagagatgaagggggagagaaaaaagagaaagcaagcaaaaagcaactttggtaatggcaagcactaggacaggcgtgaccggcaatgaccagtagcctcattatcacattttcagagactctgaagaatctgaaggcgttgagcatgggctgaagagaatgactggggaatgggtaggtgtcttgtctctcaatacgactgtcagaagggattagatttgttcttgatggcctccagcagccaaaccaggagcagcgggtggatgctggagaaagctgcatctctaaacaggtctggatggccacggtcagcactgccaggtatgaaaagcctgagggtgagggggtgagacagtgagggaggcccagcactcagtggcatggatgtcatggggaagtctgtgcatctgaagggagatgaaaccagaaaacccagttcagccttaaaattctatgatcctgctaataatgaataacccatgctccacctcccatatctgaagtccaacccacactattagttttgctgtacattcaatatctctgcatttttgtctcaacaaaaacaataagcatcacacttttttttttttttttttttttttgagacagagtcttgcactgtcgcctgggctggagtgcaatggcgcgatctcggctcactgcaacctccacctcctgggttcaagcgattctcctgccccagcctcctgagtagctgggattacaggtgcccaccaccatgcctgcctaattttttctatttttagtagagacagggttttgctatgttggccaggctggtcttgaactcctgacctcgggatccaccaggcctcagcctcccaaagtgctaggattacaggcatgagccaccatgtctggcctgcatcacatgtttttttaacccatctctctttctatatcatacacattacatgttgcttcaatatctgtgaaataaagtcaaatgcaattcgggcaatccattgatatcttcaaagaacaagaacccaacacaatgcctattttctaaactcaactaccattttttaaatagtattttttctttatgggggcaaggaaggctagccactgacatgttggtggattgtttttggaagacgtctactcaggaaagcaggcacaaataaatttccccactctcacctccagaaatctctatgctcaacccatcccagcttacgacactggcagcctgcgctccagatgcctctgctggaacgctcccctctttcttactcttggcatcagcagtgccccttcttccagtaaactgcccctcctcttcaaatcgtctctctcctcccctgtggcaagtttccactgttaattaagcttggcagatgcccttccctctctccgcccacctacctccctggctgggggagtccacaggccaagcgacacgttctgttcctcttccctgtccctgcagtcctgactggcctctggggcctaaccagggcagcgtgacatctttgtgtgcatctctgggcatcactcccacccccaacccagggagctggcagggctcctaggagctggtggggggagtggttaaaattggacaggacccagtttttacaatgttcccagagccttggacgtcattaagggggaaaaaaggcccaaagacgacattgtctcggtcatgctttgtctctgcggttattgttgtcctaaaggcctgtgtggtcaggacagtcaggaaaaggcaaaagaagccactgtcccccaaagtcacacggtgtcctttcaaggccggttgcttccatggggcggaggggcaggtgtcggcgtcatctacctctggggtttcgccatcaaatttggagtcaaatttggtgctcctcatcttctgccatggcccaatccaggaggagacaatttccccaggttctcctgaaggcacctccacccaacctgccctgaaacctaggatgggctgctgtggaaggagaaacagtgtggagggacattctctacctcacagagtgcccagggctaagggggactgtaggatcagcctcctgatgtgtgtgtgtgtgtgtgcacacacacacacacacacacgagaggagggcaccaaccacaaacttgtgcaagctaccaagtaccatgcagaggtgctgatgagatccagagaaagttggatgatgtggaaacatttccagaaaaggggagcttgaggccaagtttagacgtggacatgtgggccagagcgtgatataaggagattctttactatcaaaggaactacctgggcaacgtaaactcttattcagcagatgagggtggggtttcagaatgcatttctcacaagcccccagggcacatgctctacacactggcccagagctggagtccacaggtgggatgcacatggaagctgcagccaaaaccctgggagaggtggaaggaagccactgggaggaagccagcctggtgaccctctgggactggcccacgggcactgtctgtgtcctttccaagagcccagcccctgataattctgtttaccccgtgactcagtgccactgggtcacgaagaccacttcaaaagaaattccaggaaaaaccacccgaacaataatggaatgccccagccctcccaggccccctcccatagaccatgaggcccaagagagatggaagcacgcccccaacacaccccttccattcacctggagcttgtaaaggccctggtgactcacgcttcctcttcgtgaagctcacagtggctgaaggaacttgttccagccttgaaccagcacacagagttctccctgtcctccagaagggcccaggcagaaaggcagagagctgacggctcacggtcacagggaggccagcaccccctacctcaatccccagggaaaggagagggagacaccaagctgctactctctggagctctggggtccctgaagacagagcaggaagtgctgcctgggccccaggaggacagtcactttcagggcacctgccacatcctgccgccctcctccagctcacactgaggaaccacagcctgacgaaccacagcagaatgaccgaaggtgcccaatcgctcccggactcacacgtgtcagccaggtttccaacacgtgccccccgcctagcatggcactgggccaggttcgggagaaagaatggcaagccaggggctcaagagcctggaggttactcatctgctgtgagtagccttcagaagaaggcccttctctctgagccaaacaataatgattgcagcacagctggggccaaactgcttggagttaactcccagcccagccccttatgagctgtgtgctgttaggtaagtcactctgcctctctgtgcttccacatacttatcagtaaaatgggatgatagaagtgcttatctcttagagctgtttgaggataaactgatttaatgcaggttgagtatccctaatccaaaaatctccaaaatctgaaactttttgagcaccaacatgacaccacagcagaaaattccacacctgacctcatgtgatgggccagtcaaaatgcaggcgcaggatacagtttattctgcttcctcaaaggaaaaacaaaattatcttcaggctatgtgtatataaggtgtatatgaaatgagaatacgtttcacatctagacttgggtcctatccccaagatatctcattatgtatatgcaaatattccagaatctagagaaatccaaaccccaaaaacacttctggttccaaggatttcagataagggatattctgcctgtttgtgaaaagtgactgaaacagtacctcgcatagccggtactctaagtgttagctggtgttattatggtcagtccagacctgcagagggcccttccaactctgctgttcaattcctcaattacctacatggaaagctgtactagagtgacaagtcacacaatctacaagcaaactgctgcactgtatatggcactctcaagaaaaataatagcagctaataggtactaagcactactaagtactgggactgtgctaagcactttgcatgtattgcctccattaatttccataacaacccaaaggttgtcattattagtcccatttcacagaggaagaaactaagagttagaaaaattaatttgctgaaggtcgtgctagggctactaagagcacaaacaggatacaaacccaggcagtctaccccagcgcctgtgctctcaaatcctacacacaatactgctgcccggctccacagggaagagcagtcagagaggacttcatggaggcaggggcctggagctggccctgaaaggtggtggccttggataagcacatgagaagcccgatcagcttgcaggagacaacaggcggaacccatttctctggaagggtaagaagtctcagagcagggctggcttgggccaaggccccccagcctctattccctgggaatgggctcacctcctccctgcccacctccccacaccgagacaacactcaataggcattctgagctgagccacttccacccaagtgggaagaaagagaaggagctgtggcttcatggcccccattccatacccatgcctgtgctgcctgcagaggggagtcgcagtgtgtgggcaagcctgcactcaagagccactcaattctgtgaactgcagagatgaggaaggaggtgaccgtgaaagttgcggagtgctatcacctttggcagagcccaccttctctgttttaaagacctcctgggatgctggggggacagagggctcatatcctactattaggctactaggaagcctgcttgcagaaccatgctcagttctcaggagggaagaaaggtggcagggaaaaaaaaaagaaaagaaaaaactacactcagggcagccccagcccctccctaggggctcggcctcctaccctttaaaagcacggcccaaggctacagacactgaaacccaaactgggaagcggacaaggcccagtatttcagggaggtataggttgaccatggccctggaatggagcaaccacagacactggcatgtcatcaaggaagtcctgctgatgcgccttatatgccacccgagggtgggaaaatcctactcttggtttgtaagttaagatttaatatttgttttcctcaactgagataatgctatagtattttccaccaagttttggaacaagcagcatcactgcgctaaaaaaaaaaaaaatcataatgatgtggattccccctatttctggtcgttataagaactgctcacctatctttaaaaggtaaaggtggccaggtgaggtggctcatgcctgtaatcccagcactttgggaggctgaagcaggaggatcacttaggtcaggagttcaagaccagcctgggcaatatagcaagaccccatctctctttttttttttttttttttgaaagagagtctcactctgttgcccaggctggagtgcagtggcacaatcttagctcactgtaacctccacctcccaggttcaagctattctcgagcctcagcctcctgagtagctgggactacaggcatgcaccaccatgcctggctattttgtattttttagtaaagacggggtttcaccacgttggccaggccggtctcgaactcctgacttcaggtgatccaccccaaaatgctggaattacaggcatgagccaccacacccagccaatcccatcttttttttctaagaggaaggaaggaaggaaggaaggaagggagggagggagggagggaaggaagggaaggaaggaaggaaaaaaaaaaagtaaaggggaaggggcattgcccagataattggagatttaacctcaggtatgcagtgagatctgtgtggggtggcaggaaggaagatgatggctgccgagctctctgtccattcttttttttttttttaaactttatattttaaaataaatagagacagggtctctctttgttgcccaggctggtctcaaacttctaggctcaagcaatctgctcgcctcagcctcccaaagtgctgggattacaggtgtgcgccaccacacctggcttttgtgtccattccttaacacattccctaaccccttcccactggacttttgaggccatttataaaataatgaactaaattgcctgaacctgagaaaactctcgtatcaattttgccatctgtgactcccctcccttccccacccaaaatgccccaaggcaaaaatatgtaaagagagggaaaacaaaacatgtgcaccccagaattaaatcattcagtaccatgcaagacccttcactcgctaactacaggactggttttggtctttttctttacttttttttttttcctcttttaagtggcaagtgacagggactaaaaaaaaataaaataaaactagcacataaaggaaagatggaagtttgttgaatttcgagggatgaaaagagtccacagttggatagcctgcttgtcttcatcagcgaagcaaaggctcctggaggctttgggatgagcacaaagcctgtgtctgatgaaagccaccctctttgttctgcctcccttcagagctgccgggctgcaggttggggatgggagcagggagggagggaaggcagtgggaggacctaagaccatcaaacctgacaccaggtgggaccacctctcggttcctgctttccatcaccaaaaccaagccctgctccctgctgtcacttctggccagactaagacagttctgcacctaaaaggcacaggaggaggcccaaagagggtctgattaaggaggaggatggggccatcgtgctatgccctggaaggtgggggtggaggggggacaacgaacatagccaagcctgacagcacccacaaggcgaggtgtgaaggagtggagcagcgcctctgccccgccaccctgacagcacatgtcacaccaaacccagacaggaaatctgagcagcaggggcacccaagaggcagccaagcctccattatgctccagccggacatcccccgggggccatgtctgccctagaataaacttctgataagccccagaagtcacaacaggcaggaagcagctctctgaaaggcaccgggcacccccggctccctcctgctctggcccggtgctcaatttccactagtcagtaaatggagaagaggctgcctccctcccacacaggatggagcgcataccttgcagagtacactgccctccaccctcccagggcaactgtagcaaggcaggctctgcgtcagaccggctggctcaggcctgccactcaccagctgtgtgacctcaaataagttgcttctactttctgtgcatttcctcatttataaaataggaagaatagtaggtgatgagaacagaatgagcaacgagagggaaagcccttagaacagagccaggcgcacagcaagcgatccacaaacaccagctctcgttactgttaccgtctcacaggctcctaaggaaggcagggcatggggtggcctctgcagtgtacacagacagcagatgctatggaagggacctggaggacagtcacgcagccttcccttgacttctggagtgttttgctggttagaagctctgcattgagtactctgtatacttcccatcaccatctccctcaggagctaatgcttccccctcaacccagccatgagtgtcgcctctcaatacctgaatacagctctatctatgcctgtggataaggaggcttcctctcccctcccaccattccacgtggccatggcaattccaagccatccccagcatcccttatgatttctggttctctggttcacaaagaaaaaaccagagcgctcacagtgtgcctggaatcataccaggcttgcacctccactcatccagtcctggctcccaccacctacatacagacatcagtcagtgccctgtaaaagatgctacgcattggtgggcatgtctgtccccggaaacacaaggcccactcattcgccaaacgctgggttaatgctgggtgaagtactgggatgcagcaggaagcaagatggacaaatccctgccctcatggagctcacatgaacagggtgacaggggcgggggagaaataaacaaacataaactgtattgggtagtaagtgctatgaagaaaaatgttgcagagttaaatggtaggtggtgggggtggagaggagatgtggctattgtacagcggtggcaggggtctctctgggcaggtcatctttccccagagacctagaggaagcgtggagtgccagaggagggaatagcaagtgcaaaggccctggggccaccccatgcggggagacctgtctgctgtgggtggagggacctggaggaggatgcagatgaggtcacaggggcaataggacagctccaggcagaaccttatgggccacacagaggatgcagggctttattcagagtgagacgggaaaactctggaaggttctgagtagaggaaagccatgatctgacttacatctacttaggctcattagatgatttgttgaatgttgtccacaagcagggaagcatagaaacaagtcagacagcaaactcgcaagtccaggggagcaatgctgggggtctggaccagagtgacaagaatggtgttggtgagaagtagctggatttgagggatattttggagcttttctttctttcctattccacatttggcttggagcagagctgaaaggatctgctcataggcccaatgtggaataggaaagaaagaaaagtcaaggatgactccagggttcttggcctggaaactggaaggatgatgttggtccttgctgaaagggggaagcctgcaggaaaaacagatgggggagggagttggggaatcatgagttcccgcggggcctggtcatgcgtgaggtgcctacagacacacaagggaggtgtcaggcaggcagatggatgtacaggcctcaagttcactgacaaggtcatggctagagatgtaatctgagaattgtcagcatatgcttagtatttaaagtgatgagccttgataaaatcacccaaggaaggagtacagacagcaagggcagtggagaggtccaaggaatgaacctgagcatgcaggggctaagggaagagaagagaaatcaaccaagaagacagaggagaagtgggtagtgagatgggagagtcgaccacacaagtaaagaaactgaacacagccgggtgcagtggctcacacctgtaatcctagcactttgggaggccaagacgggtggatcacctgaggtcagggtttcaggaccagcctggccaacacagtgaaaccccgcctctactaaaaatacaaaaattagccggccatggtggcgcatgcctgtaatcccagctactcaggaggctggggcaagagaattgcttgaacccaggaggcggaggttgcagtgagctgagattgcaccactgcactccaacctgggcaacagagtgagactccatctcaaaaaataaataaaaacaaacaaacaaacaaactgaacacaactgcatgtggtcaggtcttaagagaggtgctcagatatgcccatgttgcttaatggtgaaggtaagacagacacacaatcctcccgactcctgatcaagctgaatctgcactccacctaccccctgaacttccccagttatcaaggaggctgatggaaatgaggcagagcattagggagacccttcagtgtatactaggcatcctacatggcacagctcatgtttttgttgttacactctactcatatcaggtaacatttattgagtacttgttgcaagaaaggcactatttgtatggattatttcatttaattctcccaacaatcctacaaggtgggccactatcaactcaccttctagatgaagaaatgtaggctcagagaagccaagtaacttgcccaaggccacaaagctagtaagcagagggtcccaactcaagcaggactctcatccactaaccctagaccttttttttttttttttttttttttttttgagacaaagtctcactctgtcacccaggctggagtgcagtggtgtgatctcagctcactgcaaccttcatctcccgggtccaagtgattctcctgcctcagcctcctgagtagctggggttacaggcatgtgcctctgtgcctggctaatttttgtatttttagtggagatgggatttcaccatgttggccaggctagtcttgaactcctgaccagacctcctcctttctgacaagatcagaaaaagtgatactcactagttccttctcccactggatagaaaaagatgcaagcaggcatccctcgcccagtgtcaacactcagggaacaggagatacctagtaatcactactggcaggtcaggagctcttctccaagcaggcatgctatctcgtggccagcatgcagcactgtggccaaggccatctttccaacagaaggaaaaaagggaagcatgagaaagaagggttccagtcacctctgtcacagctcagctgccagccttgtcctctagtcctggcttcaacctctctggccttgtcactcctctggccgtggatttctctggtccccctcagaagagactagtactgtctctggaacaagctagataaatatctccatcctgggtctttagaaggcagcaagaaatggagtgggccaatggagtttcaggaagctgtttatgattctgatgcttagaccaaatgcaaaagaactgtaaaggtgtccctcccccactgtcccttcgtgccacaccatcccataatggcatgttccattaatctcagctcaaggtaagctgagtcatcagccagagaaaatgatggctctgggaactgcccaagtcacatggcatgagctgggcattaggcaaggacatggcatcccaggcttcacaggtcggggacattctgtccacaaaggccaaagagggcaactacaaaggaaaagtcttatctaagacatcagcaaacgggtgctgtttctgccccctctttcttcaatgtcatctacactgccctcctcatctacttcgtgggctgcattgagaatcactgaccaccaaggcaactcagcctgggtctgtagtagcagcaactagggctcctgaggtcatggagaaccccttgcccaccacaatattcctgctgagtttgaactcgtcaggacccctgccatagggcgggaggcacaaagtgaccccatactgtggaaagggcccaggatcaggagctggatggacatgggctccctctgctttggccacctcctaatcagtgaccaggagcaaatactttttctgagcctcggtgtcatttgcacactgaggctaaaagtctttatacagtcagtatttcacaggctgtcgtgcagagcaaatgaaatactggatgctgaaagtgcttcgtaactgctaataaatgatccatttttcacctcctcaggaggctcaggtctatctctgtccccgactccactgcaaatctttcccagtcttccttcatgcttctctctactttccactgtcagcctcttctcttccacaaactccttcttccttctactcttattcaaaacacaaacaacaaaaacaacaaacatgcatacaaaaggaaaaggaattaaaacgcaagaaggccaggtgcagtggctcacgcctgtaatcccagcactctgggaggctgaggcaggtggatcacttgaggccaggagttggagaccagcctggccaacatggtgaaacctcgtctctactaaaaaaatacaaaaaaaaaaaaagtcagcctggtgtggtggtgcacgtctgtaatgccagctactcgggagggtgaggcacgagaacctgggaaacagaggttgcagtgggccgagatcactccactgcactccagcctgggtgcactccagcgaaacaatgtctcaaagaaaaaaaaaaaaaacacccaagagcttcacctccatttctctccattagaggtgtccaaaatctctgggccctcagggtggaccacacctcacctagtttcacgcaattctacgctgactttcattactatgggtgaaagctccagcttctgggccttggagttcaagaatgcccagggtttttgaacacaggaataagcaagcaggtatgagcttcaggaacctgtctccagcaactgtgaactggaaggatggaagcagggagagcctggaagctgagagaacagttaggatgttcccacaagagctgcccttaactactggtcatggggtacgggtagggagagggcccaagaccacaggtagggaagaatggaggatggtgctgaggtttgtggttggggcatcccagaaggtgacacagttaacagaggcagaggattaaaggaggaggaatgagatcgttgaaatccatcaggtagaatgcactaaagaaaatccctgtgaagacagcctgctgacactcagaaactggaatgtggcaccacagagaaagtttcaggctaacacagtccactccagagtcacaccattgagcctgcaggatgtgagtgacaagcccagagtcactaattggtaatgtgaagcccctgggttagaaaaaaacataagactcaatttgaacaatgtcattgggaaagaaaaagaaaaaacagaggagagggctggatctatggaccccctaaacagtgactatgaagtaacattgttctttttttttttttttttttttttgagacggagtctccctctgttgcccaggctggagtgcagtggtgtgatctcagctcactgcaacctcccccttctgggttcaagcaattctcctgactcagcctcccaagtaactgggattacaggtacctgccaccagaagttggctaattttttgtatttttaggagagacagtgttttgccatgtaggccaggctggtctcaaactcctgacctcaggggattcacccacctcagcctcccaaagttctgggattacaggcgtgagccatcacgcctggcctgaagtaacattgttctaagtgtatataaagttcagaatctggggaaatacttcctgtgaagacaggaggaaaaaatgagtttctggaaaagacatagaaagatcacttggagcaggggtaggaggagcaagagaatgatgcatcctagaaggcaatggggtggagggagcctggaggggttggtctgccacaccaaatgctagggaggactcggaagcaaagaaacttctgatctggtcatttggaggtcaaagatgctatgcatggagtcaattaagcaggcaattgattggccctgtttctccatctgagaattgaagggcttggataagaccagaaaaggcacaaggtgcatcttgaaagagcagccatgcatcacaccgcctgcctgagtactgtgcctaaagccatacctcagctcactgggaaaggaccccacagtggatcagcaacgtctgccttgggcaagtcgggcaagagtatctcatccccggagcacattgtttctacagacctgtccacctccagagacatggttcatggtggtcggcacttagcaggcttcccgtaattaattactgattggaattaaactctgcaatctaatctgtgtctctgacatcctttaaatgactgtgactcaaggagcgctcagggaaaaataaaaggacaattatcttttttccatcgacttcttttgaggccccgagaaacagaaagtctgagagtttggctatcagaggcgctctgggcagccctgcccaaagcagatgatcctccaatccaagacgggccctcagatgttccaaacatgcttcctctccgataaagtaacaccgtccaggagggttcaccctcattttcacagtactcggtgtgcattttggaaatggcggacttcagaagtccattcctgaaactgctgggactctttccaatgttttacagaaaggacgctgcacacacttacctgcagacatccactgaggtatccaacgctcacctttgtcacacccagagcaggagtgagcttttaaatgagactttgggtactatacactcaggctgtcacctcctatccccccacaaataaagataaaacagcacaagcattcttcgccctaaaaccctatagcaagctttcatcatgacccattccacacctgtcatctcagtacattcaagtgctcacatgggccctcagctagagcatgagcccattcttagatgcctacgctcagaaaacaggcccatgctactctttgtttaaatgcagaaagaggagctccccctaaaacactccaagcaaaatctggacacacaatgccttcaaattgccccaagtcaaccacagaaaatggaagaggagatcacagaaggatttcaaatgcataaagggatgtagattatctttcacacgtgggcaatgctcagaaaagttgatcttgagtaacgagggaaaatatttcattcactatcttgtgcaaagagaaaaaaaccaaaatccacatccacgaccctggagtacagcaaatggaatcaaagtgtgccagcccccaaagattccagcctcctgcagctcctgaccctctggccatttgcagggagctctgcaggcagtctcatctcaatggactgggaccctccagcctgcaccactatggctgctctactctccctgccccctgagcaaggcaaatgcttagtgaaagtgtgaagagtaagagttgaatctgcattttctagtcagacttcagccctctcatagtttaaggggcatcccctctaccgtccagccctgacatcctacaggtgttcagagggggcgtgactgagccaggtcacacagcaagctggtgccagtgccaggagtgaaacaagcccacaactctgatgagcaggatgagaggaggaaggggatgaaggaagtgccctccagcgaaggcaagagtgcaggaatccctaggtagagaaaggtccccccagataagcacctggacaccctgtgcaggctgtgagagccaacagagaggggcagtcggtcaacagagcttctggccaatggctcccagcctggctgttcatcagaatcatccaagctgctctttaaaaatgctggaaaaaaataaaaataaaaaccaaaaatgtctcaggaccccttcctatccccaggaatcagcacctccagcattccaggcttttaagatgctgctcagagtctctggtgagtggctcagttggggaataccaccagggtctgcacacgcaccctgggcttcctgccctctgagcttcctgaacactgccactgaccctcagccagaaatgcttgcccccttagggtaccgttgtcactagagaaccgtgtgagagtagtaatgttgctttttttttttttggagacagagtctcgctctgtcacccaggctagatctcagctcactgcaacctccacctcccaggttcgcctcaacctcccgagtagctgggattacaggcacacaccaccaggcctggctaattttttgtatttttagtagagatggggtgtcactatgttggtcagtctggtcttgaactcctgacctcaagtgatctgcctgctttggcctcccaaagtgctgggattataggcgtgagccaacgcgccctgccagtaatgctgctcttatgggctgaagtgtattcccccaaaatccatatgttaaagccctaaccccttctgcagttcctcaaaatatgactgtattggaagataaggtctttaaagatgtaataaagttaatatgaggccatgagggtgggccctaatccaaaatgactggcatccttataacaagagatcaggacacagacatgcacagaaggagaactgcatgaagaactgcacggagaacatggccatctgcaagctaaggaaagaagcttcagaagaaacctgcccatctgacgccctgaccttggacttccagcctccagaactgtgagataatccatgtctgttgtttaagcttcctggtctgtgatactctgtatggcagccttagcaaactaatacagttgcaaccatttacccatgctctgtgcaggcccttccaatacagacatcacccacatacactatctcacttaaaacttcagcccccaggacaaacgtattgctgttagccccattttacagacaagaaccccaaggctctccaagatcaaggaactaacccaagatcattcagctagaaagtcaatgaccagatgcacccacctcccagccctttgcctgtaactgctcctgagctgcctgagtcctcagtcctctctgccatccgtcctgggcccactcagcagctgcagtcctaccccacctggatgaacactgtctgagcccactgtgccttctttcccagcctcaggcccccagcagacacttcaggggaacactgacttgctatcatctgtagtttttgaaactttttctttcttttattttttaaataagcactgttgctttggtagtcagaaaaaaaaattaatattaaagagaaaaaagctaacacggttaagagtttctattgaatctgtagcctgtgtggaaagaaagaagtgatcaaaaggaatatatttggaaaggctactaagaataaaaacaaacaaaaaaaatacaagctgcccttgccaatgtcccatcagctgagatgagataagagattcatggggcagaagtaaggctgctgaggccagagatcccagccaggccatctccagaaaatatctatttttaaagtcacgttccatttcatcacatttcagaaaaacaaagaagagaccttgagggacagacaaacaggctccagagccacacgcctttgtgtgtgctcacagcagcagcagccgtgcctacagccagccggcgattttcatctgaaaaactcagatctctcatggcagagagagttccacaccgagctgccatcatcatgcagcccaacaaagcagcaattttcatatttcctagggcctgctgggctcccaacttcttagtttaaatggaaactgtcagacaggattttgtgcaaacatgcgttttcctcgggggcaaacattctgagcctacaacttgttctttcattttgagagctttttgtccatggtgactacatcaaagatgagaggtgggcggggagggctgttggggagcaccagagaacagagcaaatgcaaagtgcagggagagcagaatgaattactaggaggcaaagtgcggcaggaacttatgtgcctggcctcctcctgggcagcagcctcagaggaaagaccttggctggctctgctccccacctctcctgcagcccctgcgtggacagcccagtctgtgtcagcacctcttccctcgggtgacctacaaggtcctggagaggaaaatggtagcaaagaatgtgcaaaaaaccatgatgacagaagacagcagaattcccatatgaataggattaggtaagaaggggttaaatgtgttaatattcatcaggcggagctttgcgacatagttttaggcaatggtactgactcttctggaatcattttaaagggccactcgctttttcattataagtccattcactggagcctcttaagatagtctcaaaagacagataggaatgcgcccaaatccacctgcgcaccaacaccgtgtgccaagcaaatggaatcctcgggaaaggacacccattaaggaccatcccaaaccccgttaatatgtacatgttcctctcaagctttatgcattaaaccaagtcaactaatattttccaagctcttttaagatgtgtggtcttttatatgtgggttgtgtgtgtgtttgaggggtagtgacgaagacacccccatcaagataactgaagaagaactgcccaaactgaaacattcaaatctccaaacgtctccattccccctaggtgtttgcatttcagtggataagatgaacacctggctgtgaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcttcacaagcccacaggtaacctcccaggcctcacaagcccacaggtaaactcccaggcctcacaagcccacaggtaacctcccaggcctctgccaagcagaaccaatgaagtctgttgacacaagtcactagggaaaaaaaaaaaaaaaagtctctgcaactctgtgctccccattatcagagaaaatgaggtctgttctgggcctcccagctctgagctggctgccctgggtgcagccttccccaaaaactctgggtatccagccctcacccgtgctgacagcgcactctgtccaccagctcatgacaaaggccacttgtttcccatgagtgtccagaacagtggctgaaccagtcaacccagtcggggactgtggtcctgctggatgggcggtgacaagagctcactgtgacctcagcagacaattagcaaggcggtgtcgagttactgagctccagcaggtcacctgctaggctgggagaatggacagaatgcaggttccagacccaagaaggggttaggcagggtcacaggctacttcatctgcctccgtatctttatgctaagcactgcaccctctgacattggagggcaagaaaagaaaaggtgttacaaggaggaggctagaacctatcccaggagtaatctgagaattgagccagtggttgacaaccatcctaggaagtatttggaaatgtgtggagacatggtacggtggacacaatgatagggaggggcactgtaggtgggagccagagatggtgagcatcccaaaagtgcagaagatcccaaagccaagagcatccactgagatatactgaagtcagttccatctaccccagctgctctgaccatacctgaaccactgtactcagcacaaagccacaacaaatgtggaaggcagggaagaaccaagagttgcaagaagaaaaaaaatacaacatgcccaaaaggtggtgatgaggaaaaggggaaacttagaggcagattggggccaaaaacctatagacaacagctagcaggatttaccaatgagaacggcaagcagcttctcaaagagggatgcccctgccaacacggatgctgagctgcagcaggatgtcttcagctggagggcgctcttgagcccatcagcagccaaggtctacctgtcctacctccaagcctcttgtgctcgtcacttcctctccactgccacgatgtggccacacctctcatagctcaactcatctcatccaccccacgattcaccttgggtctctagggtcccaggtttgccatttaccaccacgggcaaggtacataatacctctctgcacctctgattcctcctctataatggcacacagaggatgaggtcaataattacactttacggccgggcacggtggttcacgcctgtaatcccaacactttgggaggccgaggcatgcagatcacctgaggtcgggagttcaataccagcctgaccaacatggagaaaccccatctctactaaaaatacaaaattagctgggcatagtggcgcatgcctgtaaataattatgctttacacttggatgtctcaaggtagcgctggagtagttattctgagctactggaatatcagcgagtgccacctccagagggagcttcccagagcccagccctgtaccatctctgagcttccaggagtccccagctctccagccgcagaataaaacctgcctggaagctggcactggagggtctccatgggcccagcctaacctgtccacaccctcccagggctcccccttctaccacccacacttctggccagactatagtgccacttgcttatcacacccagcccattcccaggtgttcccattcagttttctgattccaccatcactactgcctctaccaacatcccaaccgacccttcaggcccagctcaaatgagacctctccgaggagtttcccagatccccctacccaggaatgacctgctcccctatctccctatgcatgcctccctatggttctagctgatgtctactaggcctggcttcacctatgaggctggggtcagggtggtttcatggatgtgtgaccttgtgcagtctcacaaggctcacaattggcttcgcactctgctgttgccatcgtgaaatcctcaatgatttatgtgccgcaaggagctcccaattttcattttgcactgggcctgcaaactgcaaactgcagatgtggtcctgctgaggacttctcaaggatgaggctttggtttatctctgcatctcacagactgcagcagtgactgggacacagtaaggacttaacaaaggagggaaggtggtgagtctccatgtctctttgttctgtgagcagctgtcacctcacacagctcattattcataggctggtgagctcacctctgtcccccaacagacacacacacacacacacacacacacacacacacacacacacgagaagaaagcaacaattcagctcagctcattcccaaaagccacattccctccaaccccgctacacatcactcccacaggacatcacaaaaaaaggtcgctggatcctactgaaaatgcagcccctcagcacttcatctcaaacactttctcccacagcaggtggctgagggctggtgtgctgaaaagctcacattctgcatgcgggaacactgactccggagccatccggctctgctgcttgctggctgtataactttgaatgagtcccctagcacaaggcccagaaagggggaaccctcagggatctggctgtccccagccctgcccctctctcagactcgaccctgcctctttctgcaggttggctcagagacacaggcccccagggatcacagcaccctgccctcatcatctgcatttatggtccccacaagtcccagactcgggaggacggacacacccacaggccaaacaaggcattaggaacatgggatggcacagcttcctgggatgccccagcttcccgggatgccccagctaatggaatcgcacccagtcctggctctgatcgcagtagcacatctgacacgtgccctcaatccctccctacctcgtgacccataagcagccttttggcacaggcacacagccattagtcaagcaacctgtgagaaaaacactgcctggccatgcaaaacaaatgtaggtggcccattagaaagtgaggacttgtttgtgaaaaggtacatgtatggaatgcaacagcctcctccctctgtatctgacttgggagcactttcatcataaaattttggttgacactagatgtgttcttacttgtaagacagcacagttatcaggaagagtcacagaatgtcaacaacagaagggaccccaaagataaagtagtccagtgccccatttgacagatggggaaactgaggcctctgtgttcccagggccccagcctgctccccttggacactgcacctgtgtactatattgccaatgactgtttacaagacacctcgcacaccagacagtgaattcctggagaccagggtggtaccttcatctctgctgccctagcttccctcacagggccaggcagccaggagacacccaataaaggattgctgaatttcaaaacaatacgtgtacatgataaatatatacagtatttgtccattttaaagggtaatcaagtttttaaaatgaaaataaaggattgctgaataaatgaacaaccagagaggcggccaccagccaaggacaaacaaagctgaatctggaacactggcttcctgctgtcctctcagactaaacgcagtaggtactgggtcactgggagaatggcaaggccagtatgctgtgtgtgcagggacagggcacccccaggttgggagccaagcctagtcccagccctgcctctggcattggcattggcgtgctagccatttgaccaccagagcagcccctctctgaagctcagtttcttccattcttgattgcaggacaaataaacgtcaccttacctacccaccagtgtctcagcaaggaaggagagagagaaggaaacgtcaccttacctacccaccagtgtctcagcaaggaaggagagagagaaggaggtgaaagtgcactgaagacctaatacacaatgtatacttaagcgggactgtcaggggacaaaggtattcactggggaccccctgcccccacccagtaatgctgccacattttccttatccaccagcccatttactcctccataaccctgttaggtaatgagaacagacatctcagccccactttactgaagagaaaacaaggtcgagagaggccatcgatagtgtctgtcctccagtggccctgccaggccaaggggttgggggcacggcaaagggctccaggagtccctgcccgccccagacagcagcacctgccaatcttgtgtatcaatgggcagcagtgctgggctgtgacttgccaagtccatagtcagtccctgaatgccatagggaagcatctgctctggacggtcccgtgcttgggggcagaatgacataagtccaaagtagttcaaacggaccagcaaaaagtaaccaaaacatagccaacggcctgtggactagaagtcagtgcagacaccattacctggttttctaattctccctggaggaaactggatcaatgggggatgggggaagggacagcagtttttgaccccctactccctgggcctgaacccttcccagagctgagtcctcttctccactccctactgtctccctacccggcgcgtggcccgcatggggccttcccacaggtggactgatttttctgtccctcagaaccagagccagtggacaaaacctccgttcccaaactccaagccaccaatggaaggcctcacataggaagctgtgggtggaagatggtgcgtttctactgcctggtggttttagatctctatcgcctactcagaatctgaaccctagcctgtgtgtgtgagaggctgcacgtgcacatacaaaaacagcaaggtatctacaaggggggtcaggattgcagaggggctacctgtgtgagctctggagcccaactgcctgcctgggaatcccagcttacccactgactagctgtgtgactcagggcaagttctttaaccactctgtgcctctgtctgcacctcactctccttgcccctaaaacaggggtaagcaaagtacccacctcccaggatttttgtgaggctaaaatgagataacacctagcacacttgccagacaagaaaagttctatttttccccagcacaatgttaatagggttgcctctgggattttgtgtgcttttctttttcttcttcattaattaaattttctacatgaatgtgcatgctttattgtcagcaaagaataaagctttttttttttttttttttttgatggggtaggaagaacagctcagaatcccaagtaaccctttcttttaaacacagaggatggaagcagccctctctctgctggtctattttaggatcttctggatgggcaaggagttctactgcccaaagcagcccaaccttttctgctccctgattcccagcgtaccccttccccacctctgcccatccagaaaaactcaaatctcacctcctccaagaagccctcgctgctagctcagcacctctcttcctcctggggaacaaggcctttcctcactctgccctcccctagctggcactatccactccagaggtcttgtaccggtctctgttccaggggcaaggggtttgccaagaccccagcacagcggtcttgaggggcagggccaccttccttcctatgtcctttcaaagcactcgctctgcttttcttcttggaacttcgatacaaccttatgagaggtggacatgggttcagggaagaaaagtgatgagcaggtcacactgctggacttaaccccagtctgaccaagtccatcagggctcactctgcagccccaggctgcttcccatgggaggctcacagcaggcactcagctgacagaccctcacccgcagggcagcactgccctggcccatcatacatctcttcctccaccctgtccccgccaatgccgtttcactactcacgccccttctccttcctccccaggatttcccttctcctctggctgtgctttggtctgcagtgaccctagctgatgttctgaaggtgttcagagctaaggaggccagtgaccccacatcaaaaggggaaaagagagaaaaagtttctgagctttgtaaaagatgctactggtttttctctgttttatgtcaaataacctgtaacactcctggcaatggtacatttgagccctgagtatagaaaagaatttggcaggacagtttaaaatgtccagacttgaaggtgtcagattttgtaagtgaagaaattcagaacacagaagcaaacctcaattcagggacactggagaagtccctcagctgttcagaccacagattctgtaaaaaaaggatagcagatgtccccagatctcccagtcccctcccaagtttcaagaattctaaggctatcctggggatatcagtagtcagcgtaggctgggcgcggtggctcacgcctgtaatcccaacactttgggaggccgaggcaggcggatcacttgaggtcaggagttcaagaccagcctggccaacatggtgaaaccccatctctacccagggctcaaatgtaccactgccaggagtgttacaggttatttgacataaaacagagaaaaaccagtagcatcttttacaaagctcagaaacttattctctcctttccccttttgatgtggggtcactggcctccttagctctgaacaccttcagaacaaaaattagccaggcgtggtgatgcacgcctgtaatcccagctactcaggaggctgaggcacaagaattgcttgaacccaagaggcaaagtttgcagtgagccaagatcccgccacagcactccaggagactgtgtctcaaaaaaaaaaaatagtagtgagtgtaaatgtctatatcataacaacgtgttctaacaaagatctgtcaaccatggataatccagattttatttggctagtataacgttagcataacaaccagttgcaacatgtttcttcagagcctagatttttaaaaaatctataaaaggcaggtatagggcaattagagagatttaagaagaactatagactagaggatataattgcatcagtgctgaggttcttgggtctaataatggtggtgtgtcatgtaggaatatgtactggtttgtgcatacttcaaggtttaggggtaaactgtcctgatgtccacaacttttttccaaatgaatcaggaaaacaagttttatatggatacatctgcagagtgagaaagtaaaaaagcaaatatggcccaggcgcagtagctcactcctgtaatcccagcactttgggaggccaagggggggtggatcactgaggtcaggagttcgagaccagcccagcaaatatggtgaaaccctgtttctactaaaaatacaaaaaaatttgccgggcatggtgacgagaggctgaggcaggagaatcgcttgaacccaggaggcagaggttgcagtgagctgagatcacaccattgcactccagcctgggccacaagagtgaaattccatctcaaaaaaaaaagcaaatatggcaagctgttaaccactggtgagtctcggtgacgactaaacaagtgtttatcgtactttcccttccattctttgatggatctgaacattttcaaaacaaaatgtcagagaaagaaagtatcattaaaatgtttaaaacagaaaattcgaagaaaaataatcccactgcccaaataattctataaaatatttgttgcttactgcaggaaaaaaaaataggcatcaaaaaattaaaaagccaggcatggtggctcacacctataatcccaacactttgggaggctgaggcgggcagatcacctgaggtcaggagttcaagaccagtctggccaacatggtgaaaccccatctctactaaaaatacaaaaattagctggatgtagtggtgcatgcctgtaaacccagctactcaggaggctgaggcgggagaatagcttgaacctgggaggcgaaggttgcagtgagtggagactgcgccactgcactccagcctgggcaacagagagagactccatctccaaaaataaataaataaataaataaataaataatttttgctatttaacaattgatttaaaaacaagtgagtaatgttgtgctactgctgccatgtttcatgtaccccaaaagggaaaatatcctaagagaatctttcctcttaataaactaatgtttaggcaaacagataaaaataacacttgaagaaaaaatctggttggctcatgcctgtaagcccagcactttgggagaccgaggtgggtcaataacctaagcccaggagttcaagaccagcctgggcaacatagtgagaccctatttctacaaagagagaaagagaaagagaaggagagggggaggggggaaagggagagaaggggaaagggggagataggaaagagacaaaagaaaagagaggaaaaagaaaaagatctatcatataatttcttagtggtagaattaaagaaaaaaaaaaggatgtggttcccaaaatgagggcctatacaaacacaggagacatgatgaagtttgaaaatattctatccaaatattctggtccccttgtctctgtgtcactggagagtggtagaatttccaggcaggttctatctcctttcccatagatagcatagcccctgaggctccccagagaccctccgaagtcctgtgattgcccattcaggagtgtgggaccaccaaacactactcaagaccagcatggcttcaaggaagctttggcctcagggtagctgctgctaccacaagcaccttcctcccaggagccagaacagccttctccatcagcgcaggtgaccaagtggcacatggctcacttggccaccacgcttaggccaaagcagccctgcatgtccccatcaacctggcctccccaaagacctggattctgtttccacatctccaccctctaccacacgtggactctgcagttccctgggacttcacttttcttggagaaggagagagaaaaagggaagcaaatcctgaattgctcgtaggatttaaaaacctctccacagaggggagctggggacaaggtaggggagacagtgctagcagcacaatctgaggacgggtcccctgccagccctccgggcacacagggagcaaaaggagaggcagaggcacatgggagcaggggctgggagatgctgcatggcgcaggctgtgggcttggctattaaagccagaaaaggcctgcctcctcctgccaatagagttatcttttaatccgaaccccaatgacaccacctggcaccagcgcaggagcagctcctgacggcacacgagtcacgcggctgggccccgcgtctatcccttcaggtcagggcttgccctgagtgctcctgaggaagtgggcccctgccccctccatggcctggctcctgacaggcctgtgcatgcctgagagggccaggcaggcggtaaggaagtagaggaagctccgtgctgtgcaaggtcaccaaatgctagatgcaaagacccagaaagggagggcactcacccaaagtcacccacgccgggacggggcagcaatcccaggattctcctcctacccagatgcggcaaagaggtttgcagcccaggacagctgttatcaactagccagtgctggaaaacagcaggtagcaccccagacctgccactctccacgtactcagacaactcatggcccaatctgaagatggctttcctctgaattctcccacatctgtgccctcctgcagggcttggtttctgaggtcccatccgccttgaagttggcaagggctagggtagcatgtaacctatctccctagtaaggatggcactgactctgctgtggcagcatccaggccaggcagccatccaggccctcccagactgggggagctcagcacctccagaggcagccacctcaccacagaccaacacaccctgctgcagcgttcttccttgtgggcaatggaaatctgccagcaggaactggtagcagaaaactccccaaagcctgctccaattctccaccccagtacaatgggcgtgccctcaggattccaacagccaagggcaaaatcccgactcactggcttgggactctgggcaagtgacttactctctctatgcctcagttccctcatctgtaaaatgaggagagtagtggccttcatcttagagttgctgggatgagatgatccttgcaacctcccggggcacacatgagtggtcaacaaatgctttctatggctacactacaatgcacagttccacaggctcaaggcccagctttctgcccctctcctcatactcattccactttctcatgaccagacttgtgctcagcaagtgtccactcctataggttcgctcaggggtagctggctcaccagggacacattttaaaccctggcctcttcctccaaaacttcagctcagagccttggcaagccatccctgccgcccactggagatggctgacgagaaaaccagaaagagaccatgaaagaggaaggctcttctcactcctcactcatccttatcttggaccagtatcctccacacaacaccaacacccaaacataacagcaaatggatataatcttatcaatttcatcctccacaaccttctacggctccctctggcctaaagtcaaaaagccttaccccagactttaaaaggaagagataaacacttagtgaacatttgactatgtgtcaagttctctgctctacagtgtatatatattatatcatttaataactccctctaaaattcgtcttattgcttgcatcttacaggtgaggaagctgaggctccaagacactaggcaacttacctaagcgtcacagctcagaaacagaagcagatttggaggccagatctgggaggccacaaggctgggtccttggcacagcctctacctcctctccaggtcatctcctgcaacccctccctgacccagccactgtccagtcaccacggtgcccatggtcacctggcacacctggctgtgtcctacattaatgcatatcctcacgcttctgcttctcctgcctggaacgcacctacctatcacctaatgaacttctactcagcccagaaagctctgctctcaagttatctccttcaggagacagaccttcaccccggggcccccttccataagagaaaaacgatcccctttggctgggcatggtggctcacgcctgtaatcctaacactttgggaggccaaggcgggtggatcacttgaggtcaggagtttgagaccagcctggccaacgtggtgaaaccccgtctctactaaaaatacaaaaataaagcctgggcacagtggctcacacctgtaatcccagcactttgggaggccgaggcaggcatatcacgaggtcaggagtttgagaccagcctgaccaacatggtaaaaccccatctctactaaaaatataaaaattagccagatgtgatgacatgagcctgtaatcccagctactcaggaggctgaggcaggaggattgcttgaacccgggaggcggaggttgcagtgagccaagatcgtgctactgtactccaccctgggtgacagagcgagactccgtctcaagtaaataaataaataaataagcaagcaagcaagccgggcatggtggtgcacgcctatagtcccagctacttgggaggctgaggcaggagaatggcttgaacccgggaggcagaggttgcagtgagccaagatcgcgccattgcactccagcctgggtgacagagtgaaactccatctcaaaaaaaaaaaaaaaaagaaaagagaagaaaaaagaaaaacaatccctttccttggatgtgtttcccaagcgcccacagcaaggcacaacttatcagtccccaagtcagctgtgctgccgtctgctccctaatgtggaccattcatcctgactactacagcacagtacgtttacttgaagaagtgaataaatgatgttccttctgacttacagaccaagaaacagggccgtcagagcagacttgacctttacagggacaactggtaaacagcccatctacagtagcatcctggaggttacacctggcaaagagttaccccttggctgggtgcacctgagcaaacccatctggactaacgccggtgtcaggaagtagcacatccacacagtgcagctatggccctctgaggaaagactgctgcatcgcatcagaaaggcagcatccgtgacttctgcggtccacgctgacgggtggggaggcaccttggggcctccttcccgcactgcagacaatggctgggaagcccacaccccagcctcctggcactctcacttctaggcacaggatgcagcaacccctggcaaaagcagctcctctttgctgacctggacataaggacgccaggacccacagtgggcctgagccaacagcacccggctccaacggtggagcagcccaaggtccccctggggaagggctggaaagacgagctctctgtcctgacccacttctccctgcacactcttcccagatctggcctggcccagccagaaagccaactatgagatccttctcatcttatgacattagtaagagaaatactcactcgtatgctggtattagcacattagactccccaaggccactcccactttacagaggaacaaagtgacacccagagccaagtccctaaactgagctcctctcactcgctgccaccgagctgcactcacaccacagctctcccttagagggaacagacaggtgtggtctctgtctcccttccaggacaggcttggacactgaggagatgccgtgcctatttcccaaacaccgagtaaaaggaacccctggggtccagcccacacccaggttctgattcacagacctagggtgaggccaaggggtttaatctttcagaagcttccccagtgactctgaaaaagccaatccaaagactgcacccggggaaccccaagcgtgaacccaggactgctgtttcagcccagcaatttgtatcaacagccgttcaaagtccacaccctttgacccaacagcaccacttctaggaattcatcctgagaaaataaagaagcatacaaagatctatagcatgaggtgatgcaccgcagcattgtaagtacagaaaaaatgggaaatctctacatctccaatcaagaagaactggtgacataaatctcaatcaggcaagactgtgctcccattaaaaacgagccattgagggccgggcgcggtggctcatacctgtaatcccagcactttgggaggccgaggtgggcggatcatgaggtcaggagatcgagaccatcctggctaacatggtgaaaccccatctctactaaaaatacaaaaaattagctaggcgtggtggcatgcgcttgtagtcccagctactcgggaggctgaggcaggagaatggcgtgaacccagcaggcggagcttgcagtgagccgagatcgtaccactgcactccagtctgggcgacagagcgagactccatctcaaaaaataaataaaaaaataaataaataaataaataaataaataaacgagccattgagcatccctcattctgggcgacagagcgagactccgtctcaaaaaataaataaataaataaacgagccattgagcatccctcattcaaaaatccaaaatgctccagaatcccaaactttcagagcatcaacatgagatagtaacacctttgcattctgatggttcaatgtacatacactttgtttcatacacacaattatttaaaatagtgtataaaatcaccattaagcagccgggcgcagcggctcacgcctgtaatcccagcactttgggaggccgaggcaggcggattgcttgaggtcaggagttcgaggccagcctggccaatatggagaacccccgtctctactaaaaatacaaaaattagccgggcgtggtggcacgtgcctgtagtcccagctactcgggaggctgaggcaggaggactgcttgaactcgggaggcagaggttgcagtgagctgagattgcaccactgcactccagcctgggtgatagagtgagactctgtctcaaaaaaaaaaataaaaaagaaaaataaaattaaaaatacaattagccgggcatggtggtgggcacctgtaatcccagctactggggaagctgaggcaggagaatcgcttgaacctgggaggcagaggttgcggtgagccgagatcgtgacactgcacttcagcctgggcaacagagtgagactctgttttgaaactccatctcaaaaaaaaaaaaaaaaaaaatcacttttaagctatatgtagaaggtatatatgaaacataaatgaatttcatgtttagacttcggtcccatccccaggatatctcattatgtatatgggaatattccaaaatccaaaaataatcaaaaatcggaaatacttctggtcctaagtattttggataagggatattctgcctgttacagcatcagacctaaaacttggagcccacttcaattagtgcaggaaggactgcagatggcatctacatacaccatgaaggtgatagaactccttccctgacatggctgaggttctacttgaatattcccagaaaacaagagctctcgcaattccttaacagtggtttctggcaattaaaaggctgctctaagtcaagtgtggtggtgtgcacctgtatctcagctactcaggaggctgcagtgggaggatcagtgggaggataacttgagtccaagagtttgaggctgtagtgcacaatgatcacgcctatgaatggccactgcacttcagcctgggcaacatggcaaaacccccatctcaacaaaaggaaaaagaacatgttgctcctctcattctgtcttgctgccaccatgttagaagtgccttttgccctccaccacgattatgagacctccccagccatgtggaactgttcataggcggaagggacttgccttgtctcagatgagactttggactgtggacttttggattaattctgaaatgagttaagactttgggggactgttgggagggcatgattggttttgaaatgtgaggacctgagatttggaggggccaggggtggaatgataatgatttggctgtgtccctattcaaatctcaactgaattatatgtcccagaattctcacgtgttgtgggagggacttacggggaggtaactgaatcataagggccggtctttcccatgctattcttgtgatagtaagtctcgggagatctgatgggtttatcaggggtttccgcctttgcttcttcctcattctttcttgctgccacattgtaagcagtgccttttgccctctgccatgattatgagacctcccagccatgtggaactgtaagtcaaattaaacatcctgttcttccaaataaaaaaaaaaacaaaaacatgttgctcctaatcctgagcagagttttactttcctgaaggtaaaatctcctggctccggccgggcgcggtggctcaggcctgtaatcccaacactttgagaggctgaggcgggtggattgcctgaggtcaggagtttgagaccagcctgaccaacatggtgaaaccccatctctactaaaaatacaaaaattagccgggtgtggtggcaggtgcctgtaatcccagctactcgggaggctgaggaaggagaatcacttgaacccgggaggcagaagttgcagtgagccgagatcgcgccactgcactctagcctgggcgacaagagcgagacttcatctcaaaaaaaaaaaaaaaactctcctggctccttgtcatttttaaaaatattttcatagagatgagttgtcactgtgttgcccgggctggtctcaaactcctgggctcaatcgatcctcccacctcggcctccaaaagtgctgggattacaggcatgagtcacctcatccagcccatcttcctgtcttatgtagtatcacaagctcaataaacacgtggaatggagtggttgttttcctagaccattcatactttttccactatggccaagatgagaatatgggtttttacaagcactgctgatgcatattcacaatgccatctttaaatcaagtgtttgcgcacctcttccttccacaatcacctagctaatcatccttgtccctacgttaaaaacacccttgtccctgctgtgtcaactatcacatgacctgaagttgtccctccccacctggtgaccttaacagctatgtaacagcatgggtaactctttaccaagaccatttctgggtgaacgacctgcctgaggttgccagctcagccaaggcacaaggtgccacagagttgagtgatggagcacagccaagaccctcccctcaaagacagcactaggatgggaaagagatgtatttatttcctcttctctctctcgtcttatttatttccttttattcccatttccctcccctcacccacagtcaaccattctcttgtgttaatctgttcatattcttgcaagatgggtattgttctatatcagcaatctacataatagcactgcaccatccatgctctatttcttatgttttcactgagcactgtgcatttaaatacatcatgctgcctgccacgtgtgcttctcaccagtcacttggaattgctgcaagggactacagactcatacccacccattatacccatttgctctgcaggaatggacatccagctctacctcaccaccacaaacaacactgcagtgaacaccctggaccttccccttaggacctgcatgagaacctggggaactgacacccatgggaggggcttctgggtcagggctttgctggtaccctgccagaggctccaggacagctgcaactgcaaaggcaagagttcctgcatccccacacccactgctgataggcagcatccagctttctagttcccaccagtctaagaggtgaaacaggatcgagctcaaggttgtgttccagtatggattcttaccaaacctgactgaaccgtacctgctaagggaatggcaggaaaagcacttgtaccgtaagcatcactggtgtgaaatggaaacaactgctcattgataagtctccactgtgaggcctcactttcttgaatcgtcagggacttctggaacacaaatgtcatgcactggcctacaaaatgccatcaatcccaccttctcccactggctgaggctcctcccaaggaggtcgactgttcaggatgggcagcaacagtgctgcgctccacttttttttttttttttttttttcctgagatggagtctcactctgttgcccaggctggagtgcagtggcacaatcttggctcactccaccatccacctccccagttcaagcgactctcctatctcagcctcccgagcagctggaagtacaggcacgtaccaccatgcccagctaatttttatatttttcagtagacatggggtttcactatgttggccaggttggccttgaactcccgacctcaggtgatccacctgactcaggctcccagagtgctgggattacaggtatgagccaccgcgcctggcccagagctccacttttttatttgcaatcacatcatccttctattgatgacttacctgcagctcacactacacaccactcaccacgtgatctgacaacactgaagcagtctatacctgttcaatgagtactagcaaggtcaagttgctctaaaggttgctaaacactcaatctctgtgcttgcttacttcatcacagaccaggaaccagaagattgcaaaccagcactggtctgtagaccacaccctgagttgggggtagagtagggagaaacaaaccaaccaacccgccctggatgtcatggctgggctcctgcccccctatgccacttaaacagccatggaactgggacaatcataagaatgaaaataactgggccggcgcggtgactcatgcctgttatctcagcactttgggaggccaaggcaggcagatcactttagcccagaagttcaagaccagcctgagcaacatggtgaaaccctgtctctataaaaaatacaaaaagtagccaggcacagtggcatgcacctatagttgcagctactcaggaggctaaggtaggataatcaattgagcctgtgaggtggaggtggccatgagctgagatcatgccactgcactccagcctgggcaacagagttataccctgtctcaaatacacacataaatatagcagcttacgcttacacagtacttaccatgtgccacacactgctgtcaacacttactaacttatttaaccctcacaatacaaggtcctgttattatccccattccacagatgaggaaaccaaggcacagagagagaaagcaatttggccatggtcacggtaagtggcagattcaggattcaaacccagtatcttggctcaggtacaggctcttaattactctcctaaactgactcctgagtaacccggccttccttacctgtttcctcacttgtaaggtcaggtaaggacccctaaaaggttgctggtgagatcaaatgagaaaataaatacaaaaataataaagtatcctatgcaacacaacacctaccacctacacagcatacaaccacccatgtgtggccatgaacctgcagcagccacctacctttcacacaagccacaagagggcgagggagtcacggatcccactgcagaggtgaggacatgaggcctggaaagcagaggtaccctcagccccctctctccttagccatgctcttctcctccccaaagagacagccacaacacaggaacatgtcccacactccccagaggacacaccaactctatttccaaacatccccactgtaactctcagagttgaaactggggagaacgctggctttccaatcctcctagcaactcacagacagccagtcagacacctcaggggatcctgggaaggccagccagtctacatcctcacctacccacctgcggccaccgggtcctccttcacacatcacagaccacccatcagcctcccacccaatgccaacccaacccattcccctctccagccccagcagcctcacaagagaaccagcccagagagaatgactggaaggacagcagaggctggttggcctggcctcatttttccagcacctgctgagcgaatgctccaatcagaagccctgaattaccagacaaacccgccagtcacagaatggattctctcccaagtcctgctctgtgctctcccctcgccaggtctacctccctccttccagccgcctgcctatgcccagctcaccatacaccctccttccttaggcactgaaacttcaagcagcctcacctgtctggcactatctgtactactagatacccacttgttcaagttttccaacaagacaataaactcctggggggtggggggagagaagccatcttctttgttgcccttctgagaatctgatggatttttagacacaaaaacacttgccatgtgctataaagcacaaaatggaaggtgagaaggaggaagtcagtataagctaggctgattattttctggtatttctaaaagctccacaatagagcaattaaaaaggaaaacctttgaaacacaacagcaggatatatatgttccagctaaaagaacgaatccaggttggaatattgttcatggtagatatctttccatctttgcatgctcagcacttagccgagcctggtaaagagtagtgaccaggtacttgctggagagatagacagataaactcttgtcagaatctgggctccaccctaaagcttgtgttatctcatgcaaggagaagacactgtgaccagctccactgagttctcatgagaagcctgaagatgagggaggttacagaaaaccaaatactgcatgttctcactcctaagtgagagttgaacaatgagaacacatggacacaaggaggggaacatcacacaccagggcctgtcaggggtgggggtctaggagagggatagcaacagaagaaatacctaatgtagatgacgggttgatgggtgcagcaaaccaccatggcacgtgtatacctatgtaacaagcctgcgtgttctgcacatgtaccccagaacttaaaggtattaaaaaaaaaatgagggtggctgaggacaaaagatcaagactacatgaaatttcacaacttcccacagaaacaaggacagctggtcaccgttttgttctctctccctgggctcacaaaatcgggggaaatgcaacaagatacagaaaggtggtttgccattttctagcaaaaatgagtggggggatacataggcgcatatatactcacacccacagcccctaaactctaaaccgccatgggtttagctccgtttttttcaggagaaggactcaaaaccagcacattttggttttgtttactttcctgctttttcttggatccagctcctactgagattggctatcagggtgggtcccaactcagtgtccacggggccttatcctcttatctttataaaaggcttttttccctgggacaagaggcccggtggcctcattttcctgcctgaactctgccctgtgactaagcaagaagaagccacggcagccagcacccagagtttctgctgtgtcacaaaaaggagtcatgggtctccctgccagcatcagacccattccccgactcagcactcaatttagatatcacgtcctacgtctacatccagaaagcccccagtgtgacagatgctcagaacacatctgctgaatgaatggacgaatgctgtgacgaagagaggtggagaggtaggcaaggctcagaccacagaaatggtcacagggtggcctgcagtaccgagtaaaggtagtcattatcaaaaaactgacaaggactccagggcttgcctagcctctcagcagctgatggccctgagcaggctaccaaactctactggccgagtgtgcccatctgtaaaagataaatatcaattgcagaggctgataaaagatttttttcattgatcaggaattaaaggctgtagctcaagtccagaaactgggatgctgtgtcacttgctcaccctcactgtaaaggctggtgcccacaaagccaggagaatgtcaggaaaaactagccacggatctgagacttcccacccagcctgctcctggtaaagaagtcttggaaggaaccccagcctgggaagagacctgtttctcatttgtaaaataaggagtttgggcaaagtggtttctaagatcccttccagccatggcattcaacaatcataggctccttaagaaatgtaggccgggcgtcgtggttcacatctgtaatcccagcactttggggggccaaggcaggtggatcacctgaagtcagagtttgagatcagcccgaccaacatgataaaacgccgtctctactaaaaataccaaaaattacctgggtgtgatggcacacgcctgtaatcccagctactggggaggctgagacacaagaatctcttgaacctggaagtcagaggttgcagtgagctgagactgcaccactgcactctagtctggagtgcagcctgtgtgacagagcgagattctgtctgaaggaaaaaaaaaaaaaaaaaaaaaacataaacaggaaaagaagttctggtcagatgagaagaaaggttacttggaatgagaatagaggttaccatgaatactgaaaaggccactatatattttttttaagaattaaagtgttttattgattgattgattgattgagacagggtcttactgtccacccaggttggagtgcactggcccaatctcagctcatgcaacctctacctgtcaggttcaagggatcctcccacctcagtctcccaagcaactgggaccacaggcatgcgccacagctaatttttgtattttttgtacagatggggtctccctatgttgctcaggctggtctcgaactcctgggctcaagcaatccgcctgcctcccaaagtgctggaattacaggtgtaagctaccacacctagccagaattaaagtattttaaagtattacttcttacgttaaaatatgtaaatagaattagattttgtttcctttgttttgctatcaccttcctcaatattggctggaaagatctttactacatttggatagcagattggcaatggtcaaatatgtgcagatttaatttggggactcaggggtcatcttagagccagggaggtaccattcagacaagcaaactggggtggactctgaagaagaggtttgagaggcatgccacatctataaaaatcctgttggcagggaaaacacaccctggcttgaggtggccaccagggcagcagctctgagtcagagatggccatctctaatggcaccgctttccacacgggcagccctgcagcccccacggcaggctgcatgttagcaggagcttgtttacgcataaaaacgaacagttctcttatgcaatagaggggtaaggcaaacaagtgataacattttcttaaaaaaaaaaaaaaacaggctgggtgtggcaactcatgcctgtgatcccaacactttgggaggctgaggagggaggatcacttaaggccaggagttcaagaccagcctgggcaacacagcgagaccccatctctatgaatttttttttttaattagctcagcatgatggtgggtacctgttgtcctagctactcagggaggctgaggcaggaggatcgcctgagcccaggagttcaagattacattgagctaggatcatgccatcaatcatgacagcatgggcaacagggtaagaccctgtctctttaaaaaaaaaaaaaaaaaaaggttaatttttctatttatatctatctatcaatttatttatagagatggggtagggtctcactatgttgcccaggttggagtgcagtagctattcacaggcatgaccccaccactgatcagcatgagagttttaacctgctccatttctgacctccttaggcaacctggtggtctcctgctcccagggtcaccatattgatgccaaactggccacctgattagcatagcacactacagcccagaactcttgggctcaagcgatcctccctcctcagcctcccaagtagctaggactacaggaacatgccagcatgcccacaagaataatttttcaaaaaaaaaaagtaaccactgctcactgcaattgaccttctgatgggattttcactctgctcctccccacatcactgtcctggttaacagagagtggtttttactcgccacaaagtggctatgtgtcttttttaaaagcacagttcatcccaagaggaaacctacaaaggaagcaggtgaagacaagagtacccagtgaaaacaccatctgcagcctctggctccagcagtggctcaccaccccagctcagctcacgcaaagcaaggtgaggctttcaggtggtgcttccctctcccacatggggagcatcttaaaccaaaagcaagcagaccagtggttttcaaactgggttctgtgaactgtggagaaccccagggaaacctgtggaggagcctcaagaaggccacaagctcaagggacaagctccaagcccatactccccatcagtgcctctctcgtctaatttacagatctggctctcacctaagagtgcagttaacaaaaaagacctcatggctaaaaaaaataaaaataaaaaacttaagtcataaaagacatttacactttgtacgtgttatttcatttaattgtttgcatcagccctctgaggaaaccatggctaaacagtttcaggattgcaagtcgccacctagaacagtccactccagagctggatagcaccaatcatttttaaaagttcttcctgaaacaaccggcctgggcaaggggagctgccagggattataaaacagacttcagagacaacatcaactaaatgcagtgggtggcccttgctaaaatcctgattttaataagccaccaataaaatgacatctttgagacaagcaaaactgagcatcacccgggcaacttgataacattaagaaattattattaatgcctcatctcttagagacacatctttaagtatttataagaaaaatgacatgctgcctgggatttggttgggagagatgggtgattgttacattatcctctctgttcttccacatgtgtgaatgtctttttcattttttacttttttagagctggggtctggctctgtctcccaggctggagtgcagtggtacactcagagctcactgcaacctcaaactcttgggctcaaccaatcctcccgcctcagcctcccgaatagctggggatacaggcagtgtccccttgctcagctaatttttttttatttttgtagacatggggttttgccgtgttgcccaggctggtctcaaactcctgggctcaaggaatcctcctgtctcgacctcctaaagcgctgggattacaggtataagccaccatgcctggctcttgaaagtctttaatagaattttaaaaggaagaaagacagggagggagaatggttcttccttaaaatgaactcaattctacctccaagtaccttctggcaatcagaccatgttcagctttctgggatcaaagagaatcaggtcttatcacataccctgcaccatctgaaaatgagcagcatctaagtccctctaagtatcctttcctcaaaaacaagctcttcaaggtccttttggaactgaactcacaggtcacagcaatgccctccttaaaaatgtgggcttcaggaccaaagaattgtgaaggtgtcttttgagcagcccagagaagcatgggcctcctcgtccactgcaggcctctgccttgggcatctcccatttgaactccaagtatggcctatgccctgggatgcctcctgattccatgcacaggctgggagcttgttctctactcagggacaagctacccccagtagctccagaggcggcagcagcagcttgctcctgtctcacctaaatcatctccaccctcaccaaagccctgggtgaatattattagcccctcttctacagatggggaagagaaagcaggcccaggaggttaagcgacttgaagtcacacagcttaggagtaaagagctaagatttaagccccagtctgtgggggtccccaagagtggactcatgacattcagatgtctccagtcccgcagccttgctccctggctccaaacccaccaagaatgccccctgggtcattcatccatgtccttctcctcccaggagtaacataacactctgaaagcagagaccaccttccccacctcctagcccagaacctcccaggggctcagcaaagagttgcccaaaacttaaccagtcccagacctgcagccgccaaaccaccaggatggctctccacaaatctttccaaggctctcccagaaaccccaactgtggcccaaagcccagttctcttcactcatttctagtctctagagcaattcaaagaataatgatcacaaaaccaggcttcattcttggcgaactccataggggaaacaggaccagagaagacacacatctataaaataatgactactagccccagaatcacatgtgactatttcagctggtatcagaatttaaaagactaggggctgggcacggtggcttgcacctgtaatcccagcactttgggaggctaaggtaggtggatcacgaggtcaggagttcaagaccagcctggccaagagagtgaaaccccatctctactaaaaatacaaaaattagctgggcgcagtggcaggcacctgtaatcccagctacttggtaggctgaggcaggagaattgcttgaacccgggggacgaaggttgcagtgaaccaagattgcaccactgcactccagcctgagcgacagagtgagatgccgtttcaaaaaaaaaaaaaaataggaacgtttagtgttttggtactctgaatgagagggctaggggaaacgtaaaaaaatgatggtatacgttgatgctccagtttcacacattaatgttttaatttcccaaaaatgcattcctcagaacactgatgtcgcaagatgctccatgataaaggactctgtggttaaatcagtttgggaaacactgcctaataaagccactctagtgaagccccaaagcacactggcttagccctctcaaggggcctgcagaaaagaacctagcactgcctggatgcatttgaccacagaacccttttagggcatagcaacactaacatcccagcaaactagcagttagaagatgtttctttgggaaatgctgatctaggccttttgaaagaaagtctcaatagccttgttatcccggatttgagactgaaaaaccaaaccaatcctaaacgggataaggaggaagtatccaaagagcaaaaataacgaacatgcttcaaggcctttagggatgaagatgtaagtactgaaaacacaaagaaaatgtgtgaacattccttggctgccagatatgaatgccactaggattgtttggttaatgtctggcctccaaagagtcacatgtaggacaggtgtggtggcttattcaataatggattgtttgaggccaggagttcgagaccagcctgggcaatatagtgagaccttgtctctactaaaaataaaaaaaaaattagctgggcatggtggcacacgcctgtagtaccaactactcaggaggctgaggcaggaggattgcttgagcccaggaggttgaggccacagtaagccatgatcatgccactgcactcagcccaaacaacagagcaagaccctgtctcaaaaaagaaaagagtcacagataactactgaactgtcctaagactttccaaaccatatctgaaggaagaaaaaaaatttttttttttgtaagacagagtttcgctcttgttgcccaggctggagtgaaatggcacgatctcagctaactgcagcctctgcctcatgggttcaagcacttctcctgcctcagcctcccaagtagctgggattacaggcacacaaccaccacgcccggctaaatttttgtatttttagtagagatggggtttcatcatgttggccagctagtctcgaactcctagcctcagatgatccacccgcctcagcctcccaaaatgctgggattacaggcatgagccaccacgcccggccaaaaacaatttttagaagaaaaaaaggaaagaaaatgctatccacccccatgtcagggtgctgtgaacagtatggatttccttaattaaaactcagagtaaacagtatggtaccttctcaaaaaattgaacacagaattaccatatgacccagcaagttcacttctgggtataaacccaaaagaagagaaagcagggactcgaagagatatttgtacacccatggtgtcatagcagcattattcacaatggctaaaaggtgaaaacaacccaaatgtgtccatcaacaggtaaagaaacaaataaaatatagaatatatatatatatatatatatgaatattattcggcctaaaaaaggaattttgacatatactaaaatatggatgaaccttgaggactttatgcttagagaagtaagccagtcacaaaaagacaaatctgtattgacttcacttataaaagatacctaaagtagtcaaattcctagaaacggacaacttgagaggccaaggcggccagatcgcttgaatccaggagttcaagaccagcctgggcaacatggcaaagccccgtctcttaaaaaaatacaaaaacaaaaaatcagtcgggcatggtggcgggcgcctgtagtcccagctactcaggaggctgaggtgggagaatggcgtgaacccgggaggcagagcttgcagtgagccgagatcgcgccactgcactgcagcctgggcaagagaacgagactccatctcaaaaaaaaacaaacaaacaaaaaaaggagctgggtgtggtggcatgtgcctatagtccctgctactcgggaggctgaggtgggaggatcaattgagcatgggaggttgaagctgcagtgagccatgagtaccaccgcactccatgcattccagcctgagcaacagagtgagactccatctccaaaaaaaaaaaaagaagaaagagagagagagaaagacagcaagaaagaaagaaagaaaaaaagagacagacaggaaatattcatataatggtgactgtcaaggtctagggggccatgtagttattattcaataggtacagagtttcgattttgcaagatgaaaaatttctagagatggatggtgctgatgtttgcacagcagtgtacaaatacttaatgctggctgggcgcagtggctcacgcctgtaatcccagcactttgggaggccgaggcgggtggatcacctgaggtacggagttcgagaccagcctggccaacgtggtgaaaccccgtctctactaaaaatacaaaaattagccaggcgtggtggtgggcacctgtaatctcagctacccgggagactgaggcaggagaacccaggaggcggaggttgtggtgagccgagatcatgccattgtactccagcctgggcaacaagagcaaaactctgtctcaaaaaaaaaaacaaaaaacaaaaaacttaatgctactgaatttgtacacttaaaaagttattaaaatagtaaatgttatatatatttttccacaataaaaaatggttcaaggccgggtgcggtggctcacgcctgtaatcccagcactttgagaggccaaggtgggcggaccatttgaggtcaggagttcaagaccagcctggccaacatggggaaaccttgtctctactaaaaatacaaaaaaattagccaggtgtggtggcacatgcctgtagtcccagctacttgggaggctgaaggaggagaattgctgcaactggggaggcgaaggttgcatgagccgagatcgcaccattgcactccagcctaggtgacagagtgagactctgtatcaaaaaaaaaaaaggttcaaatggtaaatttcatgttatgtaaattattatcacaattttgtttaaatcctcaaagcaaatgggttatgagccttagtgtgaaatgaacgtcaaggtcaacaggaattatctaccaagggtttagagggatagactgccaacatgggacgctccaaacatctctatttggtttaaaatgtttctgtagcacttttgtggaacgcagtctcaaaaagatcaatagagatacaccgttcagaggaatgcagtctatcccaggtaaaaggcgaaaaaaaaatccaatttccccccagcgcaatcccatttaagattcttccctgctgaacacacatagcatccctactgtccaggccaacacgcagctcagccctctttctctatgtttgctacctctgtggctcacatcttcccagggtttcaggaaacgactatagagccccctcgcatggggcagaacatacaggtggttggaatgaggtgggacaaaaaaaaatgagacaacggccgagagtggtggctcatgcctataatcacagcactctgggaggctgaggtaggcggatcacctgaggtcaggaattcgagaccagcctggccaagatggcaaaatcccgtctctactaaaaatataaaaattagccgggggtgatggcacacacctgtaatcccagccactcggaaggctgagacaagagaatcacttgaacctgggaggcagagggtgcagtaagctgagattgcaccactgcactccagcctgggcgacagagcaaggctccatctcaaaacaaacaaacaaaaaaaaaactgaaacaaaatatttatcctactctgcttactttttcaggaaatggaaaaccagagtatcaaaaaccactcaacactaacattaaatcagattaacagcaatcctgatgtagagctggaagggcccccaaaatcgagtccaacccaatcacccaacctccttggaccaaatgccacctgggaagtgctcaaaaccccacaggaatgagcaagtctcccgtcaatgctcaacctcttctgttttgactgttgaactgggggaaaaaaaaaaaacaagcaccaggaagctaaaaggctctgccaaggtcaagattttgcagttaggaacagatctccagttcagggcttttttttttttttttttttttttttttaaagaaaagttcctcagtattcttttgaggacatcaagttgacattcaaattctatgtgtagaaagggaatgactttctactcttagacagcgtgggtgctccacatggctcctggcagccagctccacaccaccagtacctgatgggcaaccttgggaacttcagacatcaatgtcacaccacctgcttccatcacagacataccgtgggcggtgatatccctgtgtacatctggggcttgctcaagccttcctcctctcccacagcctctgccaccatgaggtcaccacttaggaatctgcatgtatatttgaagatgatctggacaaggatacatcattcactctacacacagctgactattcattcgttcaacaaaaaattatcgaacacctatcttgtactaggctctattctgggcatgaggactataacagcaaattcagctcagggaggacagctctgacacctgcttggcatagtatacaaggagctcccacagaaccctcagaaacaccaggagattcccagttttctggttctaaggctagttgctgtctactactgccactgttgtgctatattactcagggtaacaaaatgctcttccatttttcctaccatggattgtcaaatagcacagtgaagtagttagtgttttaattactttgtagaggagataagctcagaagggttaaaaaccttgctcaaggtctaaaaccttgtaaggtctgatcattactacctagacccaccatcccactccagcaatgaccgcctgtgctaactgtattatcgcacaaaggtggtaatgcttggagtggacattcatctgctcttttacctgcgtgacatcgctgctgcttgtcttcctttagacaactgctctgcctccctctaaaaacccacatagtgttggaatgggctgccaatcacagtagcccatcaccttaccctggggttccactgctgggcacagtgccaaagctgagccagtcttagtcctctagccctggccacagtgaccgggcctcatgtggacacataacactggccagaccaatcagaatcctaccatgaggtttgtctgcctgggctgattggatagagctccctttcttccctggtcaggggctgtgaacctgaacagaggggcctgaggtcatgttcagacccgtgggaaaagcccacagcatcgatccaagaggtcaaacgtcccaaaggccagtttccaccatccatccaaaggttgtggaatattctaagtcaatacatttctctttttctacctaagatgatctgagctaagtttctgtcattttgcaataaaggtaccctgaaatgatacacagataaaatctgcccttcacttaaaaacctcttctcaaccattaatttcaaatgactctgccacttcctcttaaataacacaattaaaaccacctaaattagccatgcagggtggcatgcgcctgtaatcttagctactaaggaggctgaggcaggaggatggcttgagcccaggagtttgaggctgcagtgagctatgattgcaccactgcactccactgtctctaaaaaataagtaaataaacaaacaaaagaaccaaaagaaaaaccacaacagctggagcttttacttatgtcccttgccctgctgaccctccagggcagaggggatgaagaaaaggtggctggtacccgaaggaagtggagagagaacaaaaggccaggcaacctctgctgaataataaataacccacacctgacaatcagcacccatctgcattagtcccactagaaaagcctggcagggttattcccttggggaaaaaaaacaaacttccagctctaatttctgacagtgtacaatgcctaaattcaaacctcccactcagcctagccattaaggtcctccagattacctctgcatccccaattcccttccacccagagccaaggccaaacccctgctctgctcaggctgggtaaacacatggctcctctctatggctcagcctgtgcggtccagcctacgcagcccacacgtcctccctccatggctccatgcattcagagcttcacttcaacaccaagtcccagcacattcgtgaagctctcctcggcttctccagcggacgctgctggctccattctcttaagtttgatgaagcaagccagccagttcactaggaaagtaaagaggaggcacaggaggtgtggggagtgggaacgagaaggaaacatcaggcaatgagcacgcgagaggtccagccaagttctgccatttctgcctcccaatagaggcctggtgggaatgacttgaggagtcccacatttagatggtaatgagagccactaaaggtgaatgagagtatctggggaaagtgtgtagcataccgagttttttataaaagaaaaagcctgtttgtgcatctctatcagttgacctgtctcataatgtcactctcatgagcgtcccattcccccaacaaggcggcaagctacggactagaattacatcctgtgcaccccggcccctgtctacaccccagccccacctgggccaggcacttcaatgctcccggtgacagaggcaggcagtgcagcaccattagccccatcttacagatgaagatactgaggctcaccccaggggcagggagttgagaatcctcaagggaaaaaactcaggtgtttccccaaatcaaagggaaaaaacaaaggactgcatggggctccaagtgaccaagctagacttggttactgggaaaaacaagagacccaactgagccactcagaagtaaacaattctgtcttctccctaccaccagctggggcaaaggtgttcgcttgttccccgcagatccatgtatcaaatccgggacaaaagaaagctacataatttcagagtcccacagtgactggaaatgtcctgaaattgtagtgggaaggcctaaccagggaacaggaaaaaccaccccagacaaggaatcaggggcactgggcttggccttgactcaggcacctttctgccctgcgacttcttccttacagacagggccctggaaccaaagatcataagacaccactcatctccctggggctgccacagagttaatgagatatgaagataggacacaaaatcctgaatgacaatgccctatcaataccggaataagagccacacctccaacaaaaaaaccacaacacagtgtgtctcctagtcactccacacccccaggcctgagcgtggtaggtttaaatgtctggggatctaactcagcaagagttgccccgatgggttgggtttgctcacctgcccaccaacacccaggcacatgtcctccccagtttccttccagttccaggccccacgtggtaggctgctgccgatgcagactccctcagcacccaagtgccagtgggggatgggcattctggatcaggagcccacacagggtgtggaatccatcaaggaagctcctaggtgggtgatggcatcatctccaacagagaatcggtgccaaagcagccaccccttgacgctaaggatcccagggagccagctggttcctctctcaggctccgcaatggcctcgaactgaggccaattcaaacccagagctgctgcccagagcacagagtggaaatcactcaggagtggaaggaggcaggaccaagtgctgggttttcctgactatggctcctcaaggaagaagacttccattccttcagccagagccgctctcttatgcactgagctttgaccataaggaatacttcctggctaaaagaaaaaaaagcaaaaaagtggagacctacaacacagcaatttacccttcacaaaggagcctcccctgcgccggggcagtggctcacgcctgtaatcccaacacttttgggaggctgaggcaagcagatcgcttgagctcaggagttcgagaccatcctagacaacatggagaaatgccatctctacacaatatacaaaaattagctggtgtggtggcatgtgcctgtggtcccagctacttgcggggctgaggcaggaggatggcttgagaccaggaggcggaggctgcagtgagccgagattgtgccactgcactccagcctgggtgacacagtgagaccctgtctcaaaaaaacaaaagcccccaacacgccactgtttgctgacacaccatgtcaccctcttccccaggggcttcaggtggcatcttgccataccaaatgctgtcctaacttttttctttctttttttttgagaaggagtcttgctctgtcacctaggctggaatccaagggcaccatgtcaactcactgtaacctccacttcccagattcaagtgattctcctgcctcagcctcccaagtagctgggactacaggcgcccacaaccacgcccagttaatttttgtatttttattagagacggggtttcaccatgttggccaggctggtctcgaactcctggccttaagagatctgcccgcctcggcctcccaaagtgctgggattacaggcatgagccaccacacccaaccagcgtttttctaatgcattaagtaaaatgaacttaacttctccttgaaaagtatttttctaaggatttcatgaccctctccaaagtcacataactctgcattgtggtaaaactggggtctgaaatcaatgccctaggggataaaatccaaaccctaatctctgccttccttagaggtcaagactagctcctagaacttcagccccatgaggccccacattctccaccagacacggaaagggtgagacctaattaatggcaattgatccatcaatcaattttcagagattaaggcgagcgttgattcacatgcttcccaacgcagacttccagtctgtactaagttctgtgctttacgaaagactttcagaaacagatcttaacttcttcattcagagatagattagatagatacatagatacaattaaaaagaaaaaaattactttgttgagatcccctctgtccttatcctcatggccacatctgacagtcccttcctagcatctcccaaagcactatcccaggaaaggactaggtttgcccagtaactctgacatgaccacaactggggggaaagaatgcaggtttgagggacagagatgcaagtcagaagctcaaagtggagacgggagggccaccaatgaaatgacctgctgtgtggccagcaatttagtctctctgtcagtttcctgcagctacaaaaattgaggttaagatggccaacgtaagagagctgttaccaggaatgccttataaaatcattcccttaataagtggggcttttaacagccaaataaatgggtcccatcagcctttgaccttcaggttgctaagggcagtttctcagccctctcggttcacttgtttttcttttatacatatatccttatttatttttactgtacctatcgattcactgttaaaacagggacaagacctagaaagatggcactttgtttcctggctctgaacaagttaaatcaaacaataggttataattcaaaattcctggtgcccaatactttctgagcattttaaccactccaagccagagttttctctctggcaaagaataacagaaagctcacatagtggcaacgacaactgaacgtgataaagcagagcgcctgccacaacagtagatgcccaataaatgctagttctcctcctccctcagtgccatgtcttcttcctccagctgccttgtctaaaaaggctggcttccacactccacggccaggccaggacaagcctaccacttgtcagaaactcccgccagtatccgttcctgcacccagacacacacttacaaatcagtcatccccaagaccaaagacacaggggttccaaaaggcaccctcaagggaaccagtcaccagccttcctcgttaagcagctctgtgctctcagggagagaacttagccccagcagccactactaggattttcccatggtgcaatgcaacttccccaacttttccgggcccagtttccaaagaaacccaggcaggcgttgtgcacaatcagccaccagtctgggagagactgggctctgagcagagaaaaaggagctgggacagccagaaaatgaaaaagcagttgtggccccggcacaggatggcagcgaccaaaacttaagagtaggggtcctggcccaagtcccattcttctggacggtacccttggttaaaggctagcacagggtgccaaagctagcggacggtgaggagcctcagaaaagggactgatggacatcctccgaggtaccccctacccgctactggacctggtggcccccggggaccctgtcgtcgaggcacctgagagtgaaggccttcagcggggggcattgttcacagcgaacggcgggactgggggaggcggcgggacttcgggatccgcgcaccgccgcctccccaactgggccagaggagcgagtccaccgaggccatcgccaggtggagcggcggccccggcgaggtaccctcggccagcaggagggagaagcggagggcgcgtcccagaggcgggggccaagggtctgccactcacccgcgccttcggcgggctgcggcggcccgacgacgccgttcaggtagagaatgggcagcaggtgaggctgcgtcttctccagcgccgcccgcaggtcctggaagtggtcccgctccttggccaagagcagcttgagcagcagctccgccttggcgcctcccgcctcctcgtccagctgccgccgctcgccgggactgagcgctcccgcggcctcgagcagcccgagcacggcttccacctccgtcatggcctgggccaggctctgctgacactgggcgagcagctcccggcgctggggctccatggtggcgggccgcgccgccccgccccgccggacgcctcccgggccccccgaggccggcgggcgggcaggc

SEQ ID NO: 2533 - DNA, 54393 bp, Homo sapiens
atgagatggaattcacacgtatttttatttcttccaagcaggtacagagactcaaatgtaaccctttgagctctcatgcttgaggatgtgctgctacctggcctttgagctctgtgctggcataaagcccaaggcctgggcagggcagatgatcaaagtagggagaattttaacaccagtcatgggacacagtggggagcacaaacagtagggtttaccaggcaatgctgttgatgttgatagtcctagcaaggctggcagttccaggaggaggaccagcacctccaggacgtatgacttccccccctacccatgggtgatgtgatccttcacataaccattctgctccaaggtctgccttgttctcaagtgctatacgctgattcgcacccatcacaatcacacacgtctcacacagactccagaccctgcagcgcccaactgagtactcactcacgcaaggtgaggctccttggcggtgccatctttattattcccagccacaagttatagccacaacctctcttccatttaaagtgtgcgtcacccgcagaagacaacaggtgccggagttcactcctatgattcaattctaccctcccctggcctttgcacggatcccagtggtcctggctcggatcaggcctacagcttacttcccaggcatgcttccaggaaggcagttggggtggggggtacccctttatggctcttcccaggttacatgagaactggtgatctcggtggggtctcaagtagaagccctgaattagtgttcattaacaaacttaatcctttgtcctaaaccaggctctagctcaattcaaagataaaggggggttaaacattaagaaaaatggcattttttttccacatcactgataccccaagagaagttaataggtctaccttgtagatgcagggaaatcaaaaggtcaaactataattttttataaaaactaatttttttttacgcttaatttttttcttttttttttttgagacaaggtcttgctttgttgcccaggctggagtgtagtggcacgatcttggctcactacaacctccacctcccaggctcaagtgaaccttccacctcagccttaccaatagcaggtactacaggcatgggccaccatgcctggctaatttttgtattctctgtagagacggggtttcgtcatgttgcccaggctgctctcgaactcctgggctcaagtgatctgcccccctcggcctcccaaagtgctgggattataggtatgagccacagcacccagcccaaactacaaattttaatagaattttaaacccaaccactggccaaaaatcactcggtcacgaattcctaatccacaatcacatcagtaggaagggaaagcactcattctaacacagatccaagaaccaatggctaccccgggtaccttaacagcatcaactcagaacttaaaaaatcaactagagatcatccaaggaacgtaagtataattctacaaaaaaccatctcatccccattgcagcaggccccaaactccagtgaggcttccataggccatggagaatgggtttggctcttgtcacagggtagagccccatgataggggtctgaggtagatgaaaacaacagggtagccaggggcatctatagaagatgttacagagctgcctgggcctcatgacagttgcacctcagttacaaatcccagacggctctatttgcttaaaccagtttttccagtgacgcttacatgctgactttcttggtttctatagatgcttggtttcaaaaataaaactaaaataacaaaaattccaaatccctcaaatggaacaaataaataatagtaacaatatttacataagtatgtcacattgagagattccagcatgaccaaggaatggaaaatccaagaatgtgccctggcctgtgtggggctcaggcctggctcatcgtcaggtgtgaagacaccatggggagccgatggatgtatgcagtgagctgggatggaccatgacacctggctgggctttaagtccagggaagcagtgtgtgcacgagctgtggggccgtctatagattaggtttcaagcaagcaaacaataaaaccctcagctctcccgagcagcgtggcacagtcagggtcactggtgtgagctgcaccctatcagaggagaagctgctcctggggatgccaagagggcttctctgattgctggcataggtggggacctcaggacccccgtcccagggagcacaaaactctttatacatcagctggagacaggacaaggagtcaaggtcaggcatggtcccctctttctttggactatgtgacaagggggatgtggaattcatttgtgtcgaagatcaggggcctcttgggagggttcgggtccctgtcagccttgtgaagcagcttgaagagcccggttccaatgttcattgggattcccatgatgatgcactcagacacccctgaaaccaaccagaatgaacatcagagagcctctaaacacaaggtacattttcacgaagaaagactattggcttaagtgtcagaaaattaggatgtgagtcccagcgccactccacatcaactgaactttggcaaatccctttccttcccatctaaaaagggtggctgtggagtgcagacagggggattctgcactttcagggaagggcagggcttgctcacagcccaggagcttgttggagacagagtcagctcctccagttctcctctcccacctgagccaaaggcaccctgggagggccctgcctttgagaacacaacttagcaagaatactgaaggatgcttaggaaactctaagtttgccacccagtgcttccttaacttagagcctccaagaaaagcaaacaactgggacagtagtgagcagaatacaatccccttggaaactgcggtaggcagctgttagctgtgctcaggggaaggggccaggccaggcttaagagcatctgagccttcatgatctacagccctgatgagaaacacccagaaggcagggcacctatagagttacaggatcaagggggtggtgcagattctttctccaagccccatgtcaacctggcataaggcttgagtctacgatgagcaagcaaatggctactgtgttgtagactttgtgctaccaaggaaccggagaggcaaacaactaaattaaagaccaacatgcaatgagggcgaacactgggttacaatgtgctgaaggaccaggaggaggggaaaacttcaaattgggggtggggtggcagtgccaggcagtcaaggagactggtggtggagaaaggtgctggtgtatggggccgcagagctgcggcaaaggcccggtttccaggtgtcaggcttgagtgctgggtctcagccctattgtcaggcagacttgctcttctcttggccttgggctttcttccagtcttctgtgtacctccctctggccccattctaactgctgctccttttcttttcccttcatgctagttttttttttttttttttgagacggagtcctgctctgttgctcaggctagagtgcagtggtgcaatctcggctcactgcaacctctgcctcccaggttcaagagattctcctgcctcagcctcccgagtagctgggattacaggtgcctgccaccgtgcccagctaatttttatattttttttagtagagacggggtctcaccatcttggccaggttggtcttgaactcctgacctcgtgatccacccgccttggcctcccaaagtgctgggattacaggcgtgagccaccgcgcccggcccacgcttgttttttgattttaaaaatatttaaatagacacgagttctcattatgttgcccagcctggcctcaaactcctgggctcaagtgatcgtcctgcctcagcctcccgagtagctgggacaatagcaacaccatgcccgctctcacccttctttatcttaaagacttatgtaatatttatttccctccatctccaatccctgtcccttctgaaaagagaaacagttaatcttagaggcaaaaaatgggtatatactctaatgatgccaatctgtacaagagcaggaggtgagagagcaaagggctactgggaagcagagctctggcctggaaacagcagccagacttggaatccctgtgtgggcctgactggtgtgtgccccggggcaggttgctggccctctcgaaccccagccccttaccagctctcaccccaagcctgcagggtcttcctgcggaatcagaaaggctcgagcaaagctcagcagtcagtgctggtctcacggaagaggcagggaagccagacactggggagagttcccctcgtgctccctctcccccaggccagcacagccccataaagccatgttttgtcgagtggcggggatgaggcatggtgcagagcaaggctctgctggtggactcgacagcaagcgaggtcaccttggtcttctgacttgtcaaagggcttaatatccacaccccacgggtgggtagagatacttgacacatatgatgcctggcacaggggctcagcaggcattgatggccacctcccaaggacagtaggacactctgctctgcccagcgcccagccagtacctgctcctgtcagccctggtgtcacacacaggggtcaggatcagtgtggctgactacaaagtcaagggctagaaaaattcttacatgcccagggttgctctttgcttcgtggaccaaaaaccatctgtgctgacagagggaagtcatccaacagatgtaaacggggatgcaggatgctacagtcaggatttggagataaaagatccagcagttccaattcgtgtctattgacattattcttgaaaaaataaacgctctgccactcagtttttttcattcccttggaagcctagccatggtctatttgtaaatagtaaaggcctttgatgctgttcatagaaacatcaaacctaccacacacagagtccttctgcccgaagtaggcagcgtcaaagagatggtcagccgtcttctcaaaggaggccagcatcagcacactctccttcatcttggccaggccaaacctagtgatgcccaggacttcaccctgcgtcaagggagaaagagtcacggtggtactcacaccaatggcaaaagctcgaaaccaaagcacggtgcaccttcaatacaatcaacaaaaatcctccaagacccaacgtcaggtgtgaaaggccctgaggagctatgggtccgccctctgtgtcccattgaggtggtcaatcgtcggcaacatgaaacttcacactcgcatccagacgccatcagaacaaagaagaattgagaactagaattcagagactaactttaaaaaaggggagtatttctgaagagatttcttatggctcaaagaactaaaaataaaagaatgtaaaaacctcaagtatgaagagaattaattaaatttaggtaattctactcaaaggaatattgtgccataatttaaaaagtatatttattaaaaccatgaaacaagatggaaaacatttgtgatgttaaacaaaaagtcacaacaaaaactgcatgcacacagtttcctgcgactaaagcaaaagatgcataaagaataggacttcacagaagacatcgaaccgacagcctcagggtggtaggaaatgggccatttccctcacctggtttctaaatagtctgtaatactctatcgacttgtttggggaagccttatgaaaacctgctgccctaaggcacagctagagggaaatacgttttttttggaaaagagagaaaaaaaaaatcaaaccaaccaacccacctcagcctcccgcccccaacttcagatcatgttaacttattttttcctgggaatggctacagaagagtgatggatgggtttaataagaaagaaacacctcaacttgccatgggactctctgggctttggcagtggctaattttgctttaggatgacattcaggatgaggacggaaccaagctccagctctcttcactccaccgactgggtatgagtttgccatgaggctgtaactctcatactgggatttcaccaggacactcagcctgaccagcatactttggtttttgagcaatgttcacatcttattttctctctatgatggtcctcacagcagcgtattctacatgtcttagaaactccacaggcttattctcctgaaagtgagtttcgggatgcccaggcagcccgggggcctcctgcccacataccttgtaggtcatgaggtcggagagcagcatcacgtgcctcctgtcgatgctcatgccgtggttcaccatggtgtactggatttcattgatgatcgttgtccgggcggcctcgatgcccagagttttctccacctacagagagccagtaatgagcagaagcagccccttccgggaggccactgcaaattctctccactttctcctctgccctgcagtttcaaagcaaaccctgtgccgttttccagaaatggattgctgggcaattttcagttgcagacccacggcaaatgggatggtcagagaagtatgctgggaggccgggcacagtggctcatgcctgtaatcccagcactttgggaggccgaggcgggcggatcatgaggtcaggagatcgagaccatcctggctaacatggtgaaaccccatttctactaaaaatacaaaaaaaaaaaaaaaaaaaaattagccgggcgtggtggtgggtgcctgtagtcccagctactcgggaggctgaggcaggagaatggcgtgaacccgggaggcagagcttgcagtgagcagagatcacgccactgcactccagcctgggcaacagagcaagactccatctcaaaaaaaaaaaaaaaaaaaaaaaaaaaagaagtatactgggaatcagtggaaggcctgcagatggcacaaggaagacagcctaaccctaaggcgaccccgtgggctgagtggtacctcataggtgttattggaggtggttcgggtgcccttcacaccgtgtgtggccatgactgcccgcaggttatcaccttccaccagaagcttgtacttctcctttccactctgctcgtcaatgtggatgacagctctggacacctctggaatgccctgcaccaccacctggattcagagacagagaaagctgtgaggacggggtgagccatgccctgggctgatcaccttgatcaccccagctttcagcagtggtcatctgttaacacactagagctagttttagggataagggagaacagaagttgttcaggggactgcacctcatcctaacatcagttttttgatagaacagagaggaatctaacagactaactccttggggataaggccaagaagaaattaagaaatcggactaagtgacaaagcccttaggtcccagccctgggtgtcacaccacagggagatgctgggtctccatgagaagcgacttctgtttcaccttggggagatcctctttcaggaactgcagcacgtagtacatggagctcttgctgttctctctgggggtgacacacaccacagcctcaccatgaacagccacatcaccgggcttcacacggagcttggatgtgcagatggaatatctcactgtctcagcgttcacctgcaacatggccaggtgtaggtgttactgattccagtgttgttcttcgtttatttcattgttgcccctctaagaagtccttttagtcaggtttgttctaagcaccccccacccgcaccatgaaattaataccataaatatgctacatatgttttatgtactatatgtgtatatatatctatgctttattcataaaaagagtagtttttttcacccacgacaaaatatttgcccttgaaaattcatgctcagttcatggcaacacacgcagcctctgtgggaagctctagggaggctggaggttggaggccaggctaattaaaagcttccgtggggcctcccctttacctgacactttcacaatggttcatgtgctacgttcctggatacaactcatctcttctgcaaaggagccacaaggcaggcagcaagagacaggctagagaaatccccaaactggagagcaggttgctgcatttgagtcaactgttatatgggtaacatatgaacttgatgcgtgagagaacgagctgacagaatgtgttttaagggctagtacagctttaactacccgagagaaagaagagggtgtcgggaagttactcagtttgtaccccaagttggtctgtttgtgagaaaggctgatcatctttcaactgttgcctattacccatgcatgccagtttaagaagccaggttaatctccccatctaaacacatttactgaacttcctaggctagctgccatgctgggcgctggggatccacagatgagtaagacacagccagccctagggtccttccagacactgggaagagggacaacaagaccacttatcataataccgtgtcacagtgaactggtattgcggtctgcacaaaatttcaactaattttctgtgtgtctttagatgggtatatttgtatcaaggtcaggtttagaaagaaaatgtgaggggacaacagaatcacaaaaaccagaaaccacacagaaggttctgcaatgcttcctctgtcttgcttagctcttgccctagtttatcagtacctatcttgggactaacaggatgacttcctctctacatttaattatgtgactcacttccagtctcagaagcctaatccgttccagggagagcttgacgagaataaagcagtcatcaggaagaaacacttcttcaatatactcggaaatctggagtgtcaaaagatcagactgttaatcagccgctttcccctttcctaagagcacacgactgcttgcttttttgaagagcttgagtagtgtggacgccacaggctggtcaatagatggcagctgatttttacacttccttgcaacattgctgagctagttttcttgttatcaatagggatttcttcttacctctcccaagagggttttctcaattctccctttcacgaggcgagcataatccgcgtcgtcatccttgtctagctgtgctgtgataattggagtgctgttgagaagcaaaggaaaaatggcactagcacaagggaggaggctgtttgaggactactgctttgttaaacccaagtgctatttagaatcataatgttactagcaaccccagtttactgagcaagctctgcctcccaggttcatgccattctcctgcctcagcctctggagtagctgggactacaggcgctcgccaccacgcccagctaattttttgtatttttagtagagacggggtttcaccatgttagccaggatgtcttgatctcctgacctcgtgatctgcccgcctcagcctcccaaagtgctgggattacaggcgtgagccattgcgcccagccgactatctttcattcaatgctacgtattatcattttgttaaatataggtcataggtaaaaatcattatttttgtcatcgaaggcattgtaatacatttctatttcttctagccttagatcaactagaaatcccatcatgaaatcaccaggggctcacagaatatgaccacagggcaagtggcagacatttcagtcaggcctagttaggctggaataatgacatcaaaaggatgaaatctccactgacacattgctccaatttttccagtcattttaaacattttctctcttcatgttacttgtggccataacaaaaccattgcttctattttgactgtatccagtttagactttttcttgagtggcttttttaaaaaccaaaataggattaacacagcaagcatgccacccagagtttaagacacagtcctatgaggatatcacacatatgcatgtgacacggggatcattgtttctcaggaaacaggacaggcatgtgtggaacaagaaggaaatgaaagcaggcacctgatggccttggaagcgttgatgatctctttaatccggggcacgcccagggtgatgttcatggaggccacacctgcaaagtggaaagtcttcagggtcatctgggtgcctggctcaccaatgctctgggcacacagagcacccactgcagaacctggctccatctgtgccctagaaggcaaaggtatggatgagattgcagcatgccaaagaaaagtccagcaaaactgctggggagaggcttctggttatcacctttcaacagagaatatagatgctattagggtcggaaagggtatgtctgtgacagagaaaaagcctggcatagaccagaaataggtacagacaggggaaagtaaaggtcagagagggggcagcagtgcaactcaattctgcatggctgcttgtggtcagcatgtaatggatgcagaaaatctaagcagtctgctaaccaatggtactgatggcaaacagagcagtggcatctgccatattcgttagcagtttccccatggggagaagacactaagaaatttccttgcaattatttccgttatcttggagcattcagactggcaattcatcagaccccctacagaaaatgtgacagaatctgatcaaatactggcagttaacaagtgagctggtgcagggttttgtacacatggggaaacagaagggatacgtgagacctatgtggatgaccgtcagtccaagacaaaagcatccctacctcatgtacttgtccctacaggtctccagaaacttttctacttgggtgggggtgatgcggtccagctggtacagcacacggggctgggagaatacaagccaagcacagagttagggccagcggcaactacaaacagctcggggttctaacgcgtcttggagggatattacctctgttgtgccgttatcattgatgccatatttatctctggttttcttgatcttctcagagacccccttaatgaatttttttatttcctgaaagattacacagcaaacatcatttgtaagtttcacagtcatgcagatgacataattcatttcataaacctcagttgtatatgacaagtccatcatattttagtgttagctccatatatagtataaaggacccaatctggatactgcttctactacaaagtggttttccaaggaacacaccacactgtccataccccagacacacactccattggttaatgtgtctctaagaccttctcctccaactgctctcatggcactatctacagagcccacaaagtgcgtgggagcctttgttcttgctctcccacgtgccacgagggctataagaacacagctcaagacaggtacgactgaagcatttatactgttcttctacagattaatttttgagggtttcttctgaaggtattatgctcagtttaaatactaccaactaaagcatagctttgttgacagtaaatgcatttcaaacacactttgagcttaccttcatttcaaagaaaacactccccaaacccagcttatcttttcccctctggtaaccacctctccccacaggcctaggcctacactgtcttcccacacacaattagaagtctgtaaggattcctggaaaccattgtcaaagccagatgtgaagcatcagtatatgctgcgattcccactgtatttaagaacagcactctcagccccgggaggatgaccaagtagagcaagaagaaggtgaaaaatacacaggtggaagatcagagcagggctagagactacagccctgactcaggttttctggcaaccactcaaatgggtaaaactatctgttttaggatttacagtgtgtctgtgaaatagacccagcccaccaccactcctaaagccaggatcagccagcaccttcccctggagagtgctcacagggaaggagcacttacagaggagcggttaacatcctgctcacagtgggtcaatcatcacggactacagactggctcttaaagcaattctcagggtgagctgatggcacctgccatgtagtagcaaccatcctccagaggccattatcctgccatcccgggagctggcatcggctgctctggtgtggcctagggatgatatagtctctgagaatatggggaagaggagatagactgcccctcctttgtagcagcaaggaaatcacagtggcggtaagcttgaatggcactctggccaaatgcaggcattcagctgctctgtgtgtctggatgagtacagatgcccacacatggaggacaagcagcttgagggcagactgcgtactgtggtggccgagaagcctcatgaggttctgtttcttgattctggggtaggctgagggtcccccagagagaaggccagcatgccctgcccaaagtccactcagcctattacatggctgaaaatgcctaagcctgaaccaggagcccatttctgcaaaaataaaatcctataaggtatccacagacagcttaagacttcctagccccattctatcctaaccttgcaaaaagaaatctcattagcctcctaactagccatttctagttactaccctttctacaagcaaactgctagaactttatgttcctgttaaaatagccttagcatctgtgtccacatggtcttatgcctttcccagccagctgctgcccagcttggcaagacctcactgtgaggtggcatggctttagccccaccaccctagagcagaaggcactgaaggcctgaatgaggtcagcgcttggccaaggcaaccaaccactccacgaagtcagatgctttcttcaaagtcttttctctgaacaggggtttcttcgatgtaatctttgcctactgggaaattccgtctgtctcccaggagcccaggcagccaaggggctacctcgggggcccaacacatcctggctgtcagttcccatgaatactgctttctcatgactctctgtgttggcccactctctttcttcccactgagaaagtgcagaggcccacggagggtgaccctgcagcccaatcattgttctacatagaaagggctttttatttaagaagttttaccagctgggtgcggtagctcatgcctgtaatcccagcactttgggaggctgaggcaggtggatcacctgaggtcaggagttggagaccagcctggccaacaaggtgaaaccccgtctctactaaaaatacaaaaattagctgggcatggtggcacgcacctgtagtcccagctatttgggaggctgaggcaggagaatcacttgaacccaggaggcagaggttgcagtgagccgagattgtgagactctgtctcaggaaaaaaaaaacaaaaaaacttttattaattcgcaagaactttagagttctcaagaaactctttttaaagagaaactctcctgattccttgttattaatgatgagtctgacactgtgttttcagatacagttaccttttgcaaaccagagatgaaaaataaagctgtagagggcagtgggacaacctcttctggcatggctctaacagaatattcaaaggcatttgcacttgctgccactgaatttttcctctatatattcagtataagagggggctttgcctggcagtggctgggtccttttgagaaaggtcccgaaagccctcttggcccagatgttgccatttgatcaccagttgttaaaagctgccttacctgttggcacaggaaaaacaggagcagaacctaaggccaagccttagacccagaaggttttcatctgcaagggactgtgcacacatagggagtaaaattaacacacctaaaacaatctgccggcttaggcactgggaatgacatagctcagctttcaccccaatggacacatttcccgtgggtttgctgaatgactttccctacacaaaggttctggaaattaggtttaaaaataaaaaaagaaaaacagctcactttttggaaatgaaaactgaaacaatctgctaaaaattcacactgagtcaacccatgcatactagagggaacgaactcacaacatggctattggcaggcaattcatcacacgattaaccagaagttagtgtctcatgctccacagcaggcctatgagcacgggcattctcctctggcagggacctgggctcaatgccactcaggagtgcctctgtcacctcagctctgatacgggctagggctggagaacatttcacgggctcagacacatctgttctggccagtggattttggaccctctcagcaaatctgagctcatcggattgtgagctgccggtggcaaggacatgtttagtcatccttgcatccccaggatctgtggactgtgtgacatatggtgagggctaaaccagtgctcactgaataaacaaatgctgccgggtaggaggtcacctgtgttaaaccttttcaagggcaagaaaggaaccagtccaaagcaaagcagtgtttgccagaaccgggacagaaacctgctctctctggcgctggcaaatgctggggtgctgctggagtgggccctttctgttggcgttcacagcatgctaagtacgttacctcgttatagctttcataacctgtctcagttaaggtctttgaggacaaacagataaatacgtaaacatgagcgtgaagaaaaaccaaattacaactctaatttgttagttaaaaaaaaagaataagaaagcctttggaggagaaaaacagacaaaggcacccagccttgccacactcttgattttaaaatctggaagagtctctttttcacctttcacaccttgacacatgaacacaagaagcgaggagcttccttaacacaaatattcttatttaagcttcactcgctgtttttatttttgatctacggaaagagatacattcttctttggcctgctgatcttgtgctacatttgaattactatttagtacacaaaggaaaccatttactgatttctgtatccctttgcttttgatcctaaccatgattataaacatgaaggagctgcctgagcaggtcagaaccataaaaaaaaaacaaaaaacaaacgaaccaaaaaaccttaagagggtatcaaagtaacagctccctggaagaatagaaaaggctgattcaatggatttttgatccacaatacagcaaaagaaagagcagtttaaaataaatggtatcaaaacaagactactagtactaataattattgggattcagaatgattgagggaagagttggctcacaagatagagtaggtagtaggctggtgttagggacagcgctcaaacaaaatcagcatttttcttctaacaggggaaaaaaacatttttcttctaatagggaaatggcttgagtgaaagacataaactaagaaagtcatgagataaattctgcttgttggctggtgagattttgccttggccatttttgaatgactgcctgtcatttttttttttttttttgagatggagtcttgctctgttgcccaggctgaagtgcagtggtgccatcccggtgtactgcaacctccgcctctcaggttcaagcgattctcctgcctcagcctcccgagctgggattacaggtgcccgccaccacgcccggctaatttttgtatttttagtagagacagggtctcatcgtgttggccaatctggttttgaactcctgacctcaagtgatccacctgcctcggcctcccaaagtgctgggattacaggcatgagccaccatgcctggcccattcttgaactttctaacaaaggaacaaccctaccttaaaaaacaaccagcttataaaatccacttgccagcccttggcaaacagagttctttacgacagccaggctgggtgcagtagccagcacctggcagagctcacctgcaggaagctgtcctggcagcagaggaactcactcttcttcatgatggactctgtggtcaggatcagctcgtttttgctgagagcaggctcactgggacacgggaagactgccttgagtattaaaagaaaattgcattatgtgtgggtgccacagagagcaggcggtagtagatgagagaacttacaaaggataaaatgaccttacccaaggtgagcttttagcaacctgtgatttttctttcaaaacaaattgtggactctacctttcatgtgaaggtgaaaactggataaatggatactccatcctatgcaaaaatttctgggctattcagcaggtgttgtcccatcacttcccagccttcgccaccccactgccccccaccagatttacattaaaaatataagctgttatttaaaaaactcaaacatttcaagagtgaaaatattctcccacttctgaagctcataaatttctcttttttttgagatggagtcttgctggattgccaaggctggagtgcaatggcgccatctcggctcactgcaacctctgcctcccaggttcaagtgattctcttgcctcagcctcccgagtagctgggactacaggcatgcgccaccacgtacgattaatttttttgtatttttagtagagacggggtttcaccatgttggccaggctggtttcaaactcctgacctcaagtgatatgaccgcctcagcctcccaaaggactaggattacaagcgtgagccccagcagaatttcctcttttttcctctcctctgctttgtccaagttgactcaatgttttaatggctgcattattattcttttgtatagacagaccatcatgtatttgaactatcctctactgatggtttgcctttactgtaagcagcgtagaaaaaacattcttggcatagttagaccatttctagaggacaaaaggagtttctgtaagggaaactactgggtcaaaagggacacgtatttaaaactcagaatggtattgtccagctactctccaaaaaggttgttccaagttatattctcaaagtatgtgaagtgtgcctgcttttcaatgcccatgacttataaaactggtctctagtatgctctacttgacacagagcgaaaccaaacaaagccctcttctgttggcatttgattactaccaacactagactttcaactgaaaacaactttttttttcatcttttttttttttttaagacagggtcttggtctgtcacccaggctggaatgtagtggtaagatcagctcactgtggcctcaaattcctgggcttaaggattcacctgccccagcctcctgagtagctggaactttaggagcatgccatcatccctggctaattctttttttttttttttttttttttgagatggaatctcgctctgttgccaggttggagtgcagtggtgtgatctcagttcattgcaacctccaactccctggttcaagtgattctcctgcctcagcctcccaagtagctgggattataggcacgtaccaccacacccagctaatttttgtatctttagtagagatggggtttcaccatgttggccaggatggtctcgatctcttgatcttgtgatctgcccgatgtctggctaattctttaaaaaatatttttttagagatagagtttttcctctgttgcccaggctgacctcaaacttctcgcctcaagtgattctcctgccttggcctcccaaattgctaggattctaggtgtaagccactgcacttggcctttttcctttaaatattggaaagtaaaaaaaaaaagcaaaacttttttcttttttttatagagacggggtctcactttgctgcccaggctagtcttaaactcctggcctcaagtgatcctcctgccttggcctcccaaagtgctgtgatcacaggcataagccattgtgcctggcccttcccttttaatatcggaaaattatacagagtaacacaaagaaaaaagatactaatccagtgcttgggattataaatactgaagtatttattaactgcaattgatagtccaaacagtacttccgtcctaaagaaacatccttaaaaacactctaaccccagatataatgctaaatcttactttgatgttgtccagaacccttttaaactccaaaggttcatcttttccctccatagctgcaggatctaagccatctcctccataaatgaactggataatatcgccagtagagcttcggactgtcagatcatactgggagcaaagatcttcaagagatttgacaagccttcgctaaaggaaaaggaggaaaaagctcagctgctttgagaagactagtcacatggggagaggataagatttgcaactcaagagtctcaaggttacaagcactttaatcacataaaaatactttattagaaaccctttaaaaagagtcctctcaccccaagaacaagagcaagaatgccttactagcctgtgcagtgggatttggaatatgctccaacctccaacattttagtgtattttagaacacatgcaatttaaaccgcatcacccacaaaggactctgcaactgctgttttcctaggctgttttaccttccttctctttctccctaaggtataaattaatgcaatagctttgcatttctaaacagaacttaagccaggacccctgcagacttcaatatgaattacggaggatcaggtgcaggccctcttctgggacagagggggaagaagagagaacagggacagtattgtgtctgaaccagcaggcagcaatgacttctcaaatctgcttagggagaaccgtccaccagctgaacactccagccagcaatgctatggtggctcagtgaattaaagagaaggaaatcttcctctaggcaacttcaaaacaaaaaatcccttatgccagaactaatttagtttacattaacacactgctctggcaaagtcatactctctaattcaaaaagtaaagacaaaaaaattaagtaaaaacacacattatgacaagagtggtaaaagtatttcacagtctattgggtttctgacaaaagcagcatgctcccacactgaagggcaatttcccattgaaagatgattaattgtattccatggatgacacacacaaaaaagacgattaaaggtatcagatgatacacgagctacaggagagatgatggaaataggcgtctactgacttggaaataggtgtccactgtcacactaatcacagtgtttgttctggcccactcattcacatctctggtttatctaccctggttttccagcttgcaaagggccatgcttccatagtagggagagagaagacacaaagccacagcaagttcatggcccagcaacttgtagtgttgactttatctggtgttttaagtagttaaaaacattacttaaaaaaaaaaaaaaagcagaagactcagtagccaatgcgatcaactggaagaaagggtatcagtgatggaagacgtaatgaatgaaatgaagccagaagagaagtttagagaaaaaagaataaaaagaaatgaacaaagccttgaagaaatatgggactatgtgaaaagaccaaatctacgtctgattggtgtacctgaaagtgacggggagaagggaaccaagttggaaaacactctgcaggatgttatccaggagaacttccccaatctagcaaggtgggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtggggaccaatattcaacattcttaaagaaaagaattttcaaaacagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaataaccggtaccagccactgcaaaaacatgccaaattgtaaagaccatcaaggctaggaagaaactgcatcaactaacaagcaaaataaccagctaacatcataatgacaggatcaaattcacaaataaaatattaactttaaatgtaaatgggctaaatgctccaattaaaagacacagactggcaaattggataaagagtcaagacccatcagtgtgctgtattcaggaaatgcatctcacgtgcagagacacacataggctcaaaataaagggatggaggaagatctactaagcaaatggaaaacaaaaaaaggcaggggtggcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatatccaggaattgaactcagctctgcaccaagcggacctaatagacatctacagaattctccaccccaaatcaacagaatatacattcttttcagcaccacaccacacctattccaaaactgaccacacagttggaagtaaagcactccttagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtaaataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatctaaaattgacaccctaacatcacaattaaaagaataagagaagcaagagcaaacacattcaaaagctagcagaaggcaagaaataactaagatcagagcagaactgaaggaactagagacacaaaaaacccttcaaaaaattaatgaatccaggagctggttttttgaaaagatcaacaaaattgacagaccgctagcaagactaataaagaagaaaagagagaagaatcaaatagatgcaataaaaaatgataaaggggatatcaccaacgatcccacagaaatacaaactaccatcagagaatactataaatacctctatgcaaataaactagaaaatctagaagaaatggataaattcctcgacacatacatcctcccaagactaaaccaggaagaagttgaatctctgaatagaccaataacaggagctgaaattgaggcaataattaatagcttaccaaccaaaaaaagtccaggaccagatggattcacagccgaattctaccagaggtaaaaagaggagctggtaccattccttctgaaactactccaatcaatagaaaaagagggaatcctccctaactcattttatgaggccagcatcatcctgataccaaagcctggcagagacacaaccaaaaaagagaattttagaccaatatccttgatgaacatcgatgcaaaaatcctcaataaaatactggcaaaccgaatccagcagcacatcaaaaagcttatccaccatgatcaagtcggcttcatccctgggatgcaaggctggttccacatacacagatcaataaatgtaatccagcatataaacagaaccaaagacaaaaaacacatgattatctcaatagatgcagaaaggcctttgacaaaattcaacaacccttcatgctaaaaactctcaataaattaggtattgatgggatgtatctcaaaataataagagctatctatgacaaacccacagccaatatcatattgaatgggcaaaaactggaagcattccctttgaaaacgggcacaagacagggatgccctctcttaccactcctattcaacatagtgttggaagttctggccagggcaatcaagcagaaggaaataaagggcattcaattaggaaaagaggaagtcaaattgtccctgtttgcagatgacatgattgtatagctagaaaacccaatcgtttcagcccaaaatctcctcaagctgataagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactaaaaaccactgctcaatgaaataaaagaggatacaaacaaatggagaacattccatgctcatgggtaggaagaatcaatatcgtgaaaatggccatactgcccaaggtaatttatagactcaatgccatccccatcaagctaccaatgtctttcttcacaaattggaaaaaactactttaaagttcatatggaaccaaaaaagagcccacatcgccaagtcaatcctaagccaaaagaacaaacctggaggcatcacgctacctgacttcaaactacacaaggctacagtaaccaaaacagagatatagactggtaccaaaacagagatatagaccagtggaacagaacagagccctcagaaataatgccgcatatctacaactatctgatctttgacaaacctgagaaaaacaagcaatggggaaaggattccctatttaataaatggtgctgggaaaactgggtagtcatatgtagaaagctgaaactggatcccttccttataccttatacaaaaattaattcaagatggattaaagacttaaatgttagacctaaaaccataaaaaccatagaagaaaacctaggcaatagcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaacatccagaatctacaatgaactcaaacaaatttacaagaaaaaaacaaaccccatcaaaaagtgggtgaaggatatgaacagacacttctcaaaagaagacatttatgcagccaaaggacacatgaaacaatgctcatcatcactggccatcagagaaacggaaatcaaaactacaatgagataccgtctcacaccagttagaatggcgatcattaaaaagtcaggaaacaacaggagctggagaggatgtggagaaataggaacacttttacactgttggtgggactgtaaactagttcaaccattgtggaagtcagtgtggcgattcctcagggatctagaactagaaataccatttgatgcagcaatcccattactgggtatatacccaaaggattataaatcatgctgctataaagacacatgcacatgtatgtttatagcggcactattcacaatagcaaagacttggaaccaacctaagtgtccaacaatgatagactggattaagaaaatgtggcacatacacaccatggaatactatgcagccataaaaaatgatgagttcacgtcctttgtagggacatggatgaaactggaaaccatcattctcagcaaactatcccaaagacaaaaaaccaaatgccgcatgttctcactcataggtggaaattgaacaatgagaacacatggacacaggaaggggaacatcacacaccggggactgttgtggggtagggggagcggggagggatagcattaggagatatacctaatgctaaatgagttaatgggtacagcacaccaacatggcacatgtatacatatgtaacaaacctgcacgttgtgcacatgtaccctaaacttaaaagtataataataataaaattaaaaaaatacagttaaattattgagtggagagtacagggattgaaaagacatcttttgcctgtggtcttatggaagaacacaagaagacgtatttttcactcctctgccattagggtacttttgtggtaaagtttgagaagcacaaatgctgagaagcctctagtttagccctgtgccccagagtctattatctcagagctatacactctctgaggaaatgctttccttctaagcatccaagccccgcagcaagcactggaataggtcattagagttaattagaatgatattaataatgagttacataaatagttgcaaagagagaggcagaggccttgcaataaccctcattgtcacgtgttagtaaagcgaggcttagtgaggttgaatgacatatcccacaatgtacttccatccatgttctcctctaacagcgctttgctatgcgtggctctggcctggtcttgatcatcataggatgattcggaacatactacattttttttggttgttcatttccagggcatctacctttctacattttttccttttaaatttaacccaagactagataaattacagctcatgtgcaaaacgtgtactcaatagtcaaaacccacagagctctgtcctgctctgttgctaatggcctacatttcttcaggttacctgcatgtatcccgtttcagctgtctttacagccgtgtcgactagaccttcccggccggccattgtgtggaagaaaaactcagttggtgtcaaaccggaataaaagctattagccacaaagcctttggcagctgggagctaaagagaggtagaaaaaagaaaaatcaaacaaaaaaagttcaaggcccacgattctgaaatccactcaaatcagaaaatgccccaccttgagactataaatacctggccagtatattctcactaaatggcaggctttctttgccctttccttatggagaaatactttataccagggacaaggagaatgagggcccagccagggctggtgctggtgccagtggcaggcaagtggcccaagagagggaaacctaagatctggatgctctccttaaaataggcaagcagtcaaggacctcagaggacaccctgtggatggaggctgcctgcccattccctgggaaatgacaccttcaagatatccttcctgtgggccagacctgcccacctacaaaacataaccatgcattgtcaatgtctacagggtttcattctgggcactgaaaatgttctaaaagtaggttgtagtgatggctgcacagctctgtgattaacagtcactgaactgtgtgccttacatgggtaaattatatatgaagtataattgtaataattacatatgaagtatatatgtatttaaagtttatttatttgtagagatggggtctcgctatgttggccagacgaactcctggcctcaagcaatcctcttgccttggcctcccaaagtgctagaatttcaggcatgagacactgtgcccggcctgaagtgtatcttaataaaatggcaaaaaatacatatataaaactccacatgaaattggccaacggtctttgatctgaataggtctgtgttccttggaggaaagtgtagattaagagatcttcacagttctacctgatctgctactgcttacctttgagtgtttttcaaaatgaggcaaggacctgttttcaaagccgtctggcactcgagagccactgatggcctgctgtcccacacaggcaatcatctgtgatatgttaatgaaggaacctggggacatggaccagaaatgtaacattcatttaccaaaataacactaattgaagtgcatgcagattggaagggtaaaacaggaataggcccttatgctcaatgaggtcatggtcctggaacagtagaagacagaaatacaatcaagacaacaaggagctgtcaggaacccaagaaaggcggaacgacggcgagaggagccaggagcatgtgtgggttggaggaaaggctggggaagtgacaggtgagtcttcaaggaggcttcagcaagtccaggttggactcctggaggacattatgatttggacataaagggagagggggaggaattccaaagtgggtgggaaagtaggaagcaaagacagagaaatggaaaagtgtgggctatgtcctgagggtaggaagcaggagagcaatggggtaaaaggcagcaaagttaaagagactggactttatcctgtttaaaaaaaaagtgtacagaaatagaagcacagaggttttgaatttgaatgcattatcataaaaccaaatgctttgagggcctcggtatctacaaaatagaagaattatgccacatcattaagtacattaaaaaatccctggctttcttctgcttcaacctgcctgacctgctgggctcaagtgatcctcccacctcagcctcctgattagctgggacgacaggcacaagccaccacgcccagctaatttttttttttttgtattttttgtagagatggggttttggcatattgcccaggctgatctcaaactcctgggctcaagcaatcaatcggcctcggcctcagcctcccaaagtgctgggattacaggcatgagccactgcatctggcctcatttttttttaaagaccacgttgctcaaagcaccctcaaactcagaatccagacacattaccaacaagttccttcaaagcagttaaacttcccaaaatgcaaataattaagtctctctctctgatttaaaaagatcccttaaataaatgaaatgtctgtttggagctgtgactatcacattttctggagccaaacagcctgtacggagaacacactgccagcaggtgagagaggggcatgcagacctttggagccgcacagagccatggtgagggggctgttgctcttgtccagctcccggaggcaggcactgccagcgtggtcacggatcacagacagctccttcaggatcagtgcctagtgggagaaaaggagatccttggtgggttgtcctcattgtctctgtggattacaaatgttcaatctaacatttaaagaaatttgaaaatactgaggcaagatgcccgatttccgatcagtaaatgtttcagaaccttagaggagcaaaatgccctggctatatgaacatgtacatcttctacaaggttctaaaattggtgtataaggcaaacagtttatcttttttttgtttttgttggagacaggatctcactctgttgctgaggttggtgtacaatggcataatcacagctcactgcagcctcaaactcccgggctcaagtgatcctcctgccccagacccctgagtagctaggactacaggtatatgtccctaccaggcctggctaatttttaaaattttttttgtagagatggggtcttgctatactgcccaggttggacttgaactcctggcctcaagggatcttcctgccttgattataggcataagccaccaagcctggcctaaaattgacagtaataaaaacttgaagaatcctttaaatggcccataaggtagaatgtatggctttgtgtatactaccctacacaacaaaatatctgtatataaatagctgtgtggacacacacatgcaccccatacaaatatataagataatatgtggtatgtaaaagagaattgcctgtactatttgtaaatttgtctttctactttttcttgccaagcacacatctgaatgtctgcaagctaggcatgtgatgaggtgacttcacaagaatattccggctcatgagctcatccacagttactcctcaacttacaaactaggatgctgaatcagttacaagtctggttccatgaaaaattgctgctgccgaggtctcaagtaattttctaggaggtaccggtgagggatatccttttctctctctctaagactcagtaagattaagaatgagctaatggtaaatacctcacaaaattctggtttctccctgctttagaaaatgtatttcattagaaaacttcccaatgcttaaagagcctttcttccacactcaggtgagtcaaagctcagtgccacgggtttatcggtgaggcagaagacggccaggtgaaagcctggtgcactcagactgctgagggagtttcaggttctcacaggctggtggtgattctgattctgacccatgctggttgagatcttagctaaaatagtttcaaatgaggggcagcaggctggggatgtgactattagacatgaattctccctcttccgcatccaagtctctttcaaagaccatacattcaaagagctgtggtgaggctgggcacggtggctcatgcctgtaattccagcactttgggaagccgaggtgggtggatcacctgaggtcaggagttcgagaccaggctggccaacatggcaaaaccccgcctctactaaaaatgcaaaaaaaaaattagctgggcatggtggtgggcgcctgtaatcccagctacttaggatgttgaggcagggataattgcttgcacccaggaggtagaggttgcagtgagatgagattgcaccactgcactccagcctgggcgacaaagtgagactccatcttaaaacaaaacaacaacaaaaaaactggctgggcgtagtggcttacacctgtaatcccagtactttgggaggccaaggtgggcagatcacgaggtcaggagatcgagaccgtgctggccaacatggtgaaaccctgtctctactaaaaatacaaaaattagctggtcatggtggcatgtgcctgtaatcccagctacttgggagggtgaggcaggagaattgcttgaaccagggagtcagacgttgcagtgagccaagatcgtaccactgcactccagcctggctggagtgcttcataaaactatgaaaagcgagactccgtctcaaacaaaaacaaaaacaaaaaaaaccaaacccccaaaaaccaaagagctgtggtgtcagtttctacttgaaggatgctgaaaatagaaaaggcaggagcactcgagtaccagttacagaagggacctgagtgtgccaccagaacaagagcagcctcgtgtggccgaatgaacagatggctatgttttcaccacctggatgtgaaagttaggagggacatgaggatctgatgaaaggccctaccctcaggaaacaaacaaggacacacacagtgagcccagggccccaacaggacagacgaggacatacacagtgagccctgggccccaacaggacagacgccaatgccttgacttgcccactcctttgctacctctattcatggctcagcacaaccccagagagcaccaccgtagccactgtgcacggcaagtggcgaccctgaaccaaagggccgggctcacctccagggtctcctcagcagtgcagccaggctgctgctgcagcttgcccgtgttcagggcttcgatgtactcatcacatttcttgtagccggcattcagcaactcatacttggccttcagcagtccttggccaggtgtgacatcaccgatcccaattgagaaaccacggttagctgttgagttggtagagcaggaagaaagggccataaatgagactcagcaaacctactaaatacagtttatgcctgctagatatagtttgtactatatataaactatgtatgtatagtttaaagtataaaaaagtgtatatcttcacagaattcatcacaattcaattaaataatggctttctttctcagtcattagggagttacacaaaatgactaggactcaactgacttctctcagagaccttacgatctggtggggaaacacaataccgtttccaactattatctaaagcagagtgacattaaacactaaagggtggcctgagggctgggtgcagtggctcacgcctataatcccagcactttggaaggctgaggcaggaggctcgcttgatcccagatgtttgtgatcagcctcatctctacaaaaaccttaaaaaattagccgggcatggtggcacatgccagtagtcccagctacttgggaggtggaggttgcaatgagccataatcacatcactgcgctccagcctgggcaacagagcaagaccctgtgtcacacacacaaaaaagtattctccaactttgatggaactaggtgccaccattgatcctagccacaatatactgtatgtagaaataaagagagtgaatgagtggcttctggcttagcaggataggaaggtatgacctacaagtatctgtagatgagaggactaatgggcctggaaaggctcagaaatgagatcattaggttctgcaactgctggaaatgatgaatgtgctggaaacaaggaaacctagtggaaagtctgtataaggaaggctccaggcccttattcctgtaggagatgggagttcgctcccagcgaaatggaatcagagaggctctgggtctgggaataccaggcagatgaaataactgtaaacaagagcactgagggaaagtctgtatattccttttatataaaaaaactgagaggtccatcaaccagtcagctccatttccaatcagtgtttcagtccttactcctcaaggaccaccagatatttgaggaaagattttaacatgaaagacaaaagacacaaatgcacaggaaaaagaaagtaaaaggatacagaaaattcaggaagcaaatataataaaactatgaataatattctctcagagtgatcagagaagatacattcagggatcaaaacaagaaagctttaaaaacaaaacagcctgggcatagtggctcacgcctgtaatcccagcactttgggaggccgaggtgggcagatcacttgaggtcaggagttcgagaccaccctggccaacatggtgaaaccccgtctctactaaaaacacaaaaattagccgggcatggtggcaggcacctgtagtcccagttactcgggaggctgtggcaggagaatcacttgagcctgggaggcggaggttgcagcgagctgagattgcatcactgcactccagcctggcgactgagcaagactctgtctcaaaaaaaaaaaaaaaaaaaaaaaaaagaaacaaaaacactacctgtgaataagtatattgaaaaatagtattggaaattaaatacatgacagtgataaaattttaaaaatcaacagaagtattaaaagataaagtgaatctagaataaagaaatggcaaatggaaaagaagataattagataattaatctaggagttctaatatgtaattaactgaagttccaaaaagaaagaacagagaaagtaaaagagagaaaattattaaagaaataacataaaatttcccgaatggaaggacacacagctgcagattaaatgaaattactcagtgcttagcacagtgaatgaaaaaagacccacaccaaaggtatattgttgtgaactttcacagtgagaacagagaggattctgaaagtttctaaaatgaaaaaaacaattcaagggccaggcatggtagctaatgcctgtaatcctagcactttgggaggtggaggcaggtggatcacttgagaccaggagttcaagaccaacctgggcaacatggtgagacttcatttctacaaaacttagttgggcatggtggcacatgcctgtagtcccagctgctcgagaggctgcgtgagccaagatcacaccactgcactacagcctgggtgacagagcaagaccctatcttcaaaaaacaaaaaaaaatcaaatacaaaaactggggaataagaacgacaatacctgttaacaacaactctgaaagcaagaagaaagtagagcagtaccttcaaaattctgagggaaaataattttcaatctaaaattgtatacccaggcaagtataagagtggaataaagttttgggggcatgcaaacatcacttgactcatggcccactcaaagcatgagcaaacaaacaaacaaacaaaatagaacagtgaaagcatagtaggcaaatattgagtaatcttggagaactgaatcatggatagccccaagtgttctagtgcttccacagggaccttggaagcagcccatcaaggatggtttataatctaaccctgtctagaagaccgtagggagctactgctggttttgagaagagaactgaaaagcaaattcaaatctgttgtgaaactattcagtactgagttaatttaattaataacagcacacatgatttagcctggaatgagtatctttttctgtatgtatatgtgtggtggggatgaaatggcagtaaaagaacaaaataacgtaaacccttaagactctaacaattgcagctttaactaaaagaaggatgctgagatacttacacaggtagacaggagccagcctggcgagccgtgacatggcatctgcagcttcattctgtccccagtctcgcagcaaaatgtaaaaaatattgttcttggatcctgaccctagggttcctttgtccatgctgccactcatcaactcactgttctggattgtaacatctggaagaatgattatatatttagacaacaattatttattactttgccttattccaaaatgaatttgagacagttgagaaaatatgttcccatactgacacttaaagcagaacaaacagaaattctcctcaaagcttttttttggggggagggagggggggttaaaggaaaacttgggaatttttgaaaaatatagaaactccagttagtgtgtagtcctaaccctgaaatataccagttgaccctcactctcctcatctgtgaactgtgggtaacagtatcaagcacttgtcatctttatgttatgggatattttgagcatcagatgaaataacatacagtgaagtgctctataaactataaataatttgttactcatataagatattaaatattaacaaaggtaccatcatgtacagcctatacaacaaccaaatgaaattcatatccaaaaagaaacaaaacagtctaaaacaagaagctgaagtattttgaagatcagagagcatatttccaaagaaataaatctgaggagtatcagtgcccttcaaaacatttgctcttcattagaagacagcagaaatcctgaccttcagaagaactctgcaattcagttcttcagtacagagtcctggagatccacttctagtcccaaggtctcactagcaaagcccattctaaatcagtgctactcaaactaggctgctagggaactgtttggtagtggtctgggtgagtgaacgtgctcacatcagaaagtaactcaatggatgctggctaaacagcagggctctgtggactgcacttcgggttgaactggtttagacagactcagatgacttgcatgtaaatcctttccctggctgggtgaggtggctcacacctgtaatcccagcactttgggaggatgaggtgggacgattgcttgagcctaggagttcgagaccagcctgggcaacgtagggagaacctgtttgtctttgaaaaaaaaaaaaaaaaatcaatccaggctgggtgcagtggctcatgcctataatcccagcactttgggagggcaaggcagatcacttgaggtcaggagttcaagaccagcttggccaacacggtgaaaccccgtctctactaaaaatacaaaaataagccaggcatggtggtgggcgcctgtaatccaagctactcaggaggctgaggcaggagaatcgcttgaacccagtaggtggaagttgcagtcagctgagactgcaccactgcactccagcctgggtgacagagcaagacttagtctcaaaaaaaaaaaaaaaaaaaaaaaaaattaaatgccttaaatagtaaaatccttgtttattgccccccccgccgccaaaaagatgacaaaatacagacaaactactaagtgagaaaaactagtcacttaagacaaaacacatttggagagaacattctaaccactgcgtcatgtgtctacatgatctctacttttaagagaaatggggaattacatctgagagaagaaaaaccagctacattttcctgaagaaaaaactttccacctaaggcttacagaaacaatgaatttgcttgcttcgcgaaggtaccagcaaagctgatgaccagccacttgcttttctgtcacgttcctccttctccccacccgagttccgtccactcacaggaatcattggcacagagatcttcccctttgccacagtactgcttgcccttggttcgcaggttggccctcactggattgtcatcgctaggcctgaggatgacactgaagatctgctttcccgtccacagggtgacaggctgagggggggaggaagcctgagagtcagtgggctgagcctggtctcaatcccccttcagtagacgaagccaggcggcctagggactgcactcaagcctagcaccaacacggttccactcatttcaccagtctacccccacagacacatacacacacctgtgcaccaacacacaactcccacacacacctttaggattgtaggcggtgggaggcgaactttaattttctcatccttgccaaccagtattgaagcaatgatttggcaagccttggctcgatcaaagaaagtgtccttgagagtgaggagataggcacctaagcattaggaaccaacacaaaacaaagaaaaggaatgaaattgtgagaatactgcaaggtttcaattttaaaataaatttgaaccatgaccaacagcgtgaattgaaacaaacagctgcttactggctttctcctccaactaggatctacctccacaggaacgtgactttgttttgttcactgctgtatccccaggcaaaagggacagattctaagccagacactaggtttagaaaatgcccagtccatgagaggagctcattaaagacttgctgaattaatgaataaccaaccaattaaaaaaaaaaagaaaaaaaaaaacccacggggaggttcatgatcaaacttagtaaacaaaaaaccaaattaaacacaggctattaaatagcttttcaagtcatcacatgaatcactatgaacgaggaacactgtgttccagtcagaaatctcctttcaagtgaacttcaccaacctacctgttagaaaatcctgaatagcagcaatcagcggttccccattcctcggggttacaagatttgctttagtctgtaggaaaagtaagcgcagtcagttagctgttctcggatgcatgatgcagcccaaagcctgaatcacaaggtttttgaatagttatgaacaaatacagagtagcagaaggacgaggctgagaaatgaaagccaggggtctgaatcccagctttgtcactaactcccagttcctttatctgtcaaggggagagaaaaaaataccagcaagattgacctaggagggtcctaccaacaccaaaatgaaatatcaagtgaagttgtttcagaattctatgaaaaactctacccatgtaagaagattttattgttgtttgtttttgagacagagtcttgcttatagcccaggttagagtgcagtggtgcaaatatggctcactgcagcctcaacctcatggggctcaagtgatcctcccagctcagcctcccaagcagctgggactacaggcccacatcatcatgcccagctaagtttttgcattttttttgtggagacggggtcttactttgttgcccagactggtctcgaactcctgggctcaactgatcctcccaccttggcctcccaaagtgctggtattacaggcatgagctactgcacccagccctattgttattactataggtgcttctccaaagaaaattcatttctgtgaatgatgaggagcgttgtgacctctgaagtcaaccaattccacacttgtccacaatgatgacagaactgttaaatgtcccttggttaagacattacgttctaataataatcaatccaacaacagaatttaattaaacatttaatgagggcctacgttgggcaaaaaagggtgttaggtagtaaaacataattaagtcatgtaaagaaggctctgtgtgtatgagagtacatttgctctaatcttgatatgaaaatgcacatgtgtatttgtgggttttctgggccttttcacccagaaagcagggtcctctcagacaaaggcccattaccacttacttctgagccactatccaaagcagggacccttcaaccagagtgggagacagctatttagccagatgtgcctcttcattgcacaccacctgactgctcttactcctggtttagagactctctctgaggtgggatacaggtagtctacggatagaagcagagtgcaaggggctgagattagtgtattttgaaaaggtctcctgggtaatttgggcccacatccaaattagagccctatgcactacacggagaacagcattgctaaatcagaacgataggtattttcttacttgaaattgaggaaacttgtccacatggtaactaaggattcttctaccccaaaatccttggagactttgttttattattgccatttgtaaccaatgaaatatgcagttgtaacacaatgtccacagtatggatcctcaatggcagagttgacagcaaagtctaaatggttggttgcaagctgatagctattatttcaagcagcattctaaacattactttttgttacaaaaataatatatgctcattatagaaaataaatctaaggccaggtgcaatggctcacacctgtaatcccagcatctggggaggccgaatcgggcggatcacctgaggtcgggagttcaagaccagcctgacgaatgtggtgaaaccctgtctctactaagagtacaaaattagctgggcatggtggcagacgcctgtaatcccagctactcaggaggctgaggcaggagaatcacttgaacctgggaggtagaggttgcagtgggctgagatcacatcattgcactccagcctgggcaacaagagtaaaactccgtctcaaacaaacaaacaaaaaaaaaaagaaaaagaaaaagaaaaaaaatctaaacgtatagacaacttaaaaccccaaaatgatgcatgcaatactaaaagcctaaaccaaaacaggttaaaagcatcacatcagaaatggtaataagtgattttggaggtagggacacttacaactataagacttaccagttcctaatataggaagctggaatactgaaaaaagaaagcctgaagctctaaaatactcagtagttggggatcatgaagttcaggaggagagaatcctacacagccggtgccatgtcccactgtgctattgctgggtcaggagtgaatagtacatgtagtgccaacaggttttttttttttcttcttttgagacagggtcttgctctgttgcccaggctgaactgcagtggtgcaatcacagctcactgcagcctcaacctcctgggaccaagcaatcctcccatttcagcttcctgagtagctgggactacaggcgtgcgccaccacacctggctaatttttgtagttttcgtagagatggagtttcgccatgttgtccgggctggtcttgaactcctgaactcaagtgaaccacctgcctaggcttcccatagtgctgggattacaggcctgagccacagcgccagcctgtgccaacagttaaagctcaactgtaagctccttaagagcaggcacgtgcctcactatcaccgatctcctgcagcatctactgggcactccttatgcatttgtcaaataaagtggtggtaagagttattatcattatgtataatactgcatcctctaagaagacgaagtatgtaatatagtttaggaaggtttccattcagaatgttcaataaaatgtgctggtgcttaaagaatcttcagctactggaaaatttacttaggtaggacatcttcttcccctgtgacagccaacattgatattgctatattcttttcttaccttgtcataactggccctcatgtatacattttctcccagaacccacatttataggccagaaaatcccctcaacgcatctgttacagaccctaactctcatgtatatactataatttctaagagattcttcaaaggctcaaaagaaaccaataaaaagagagatatataggcagttagtggtcggtttaagaacagaaagagcctggcttctttggcgttgttagttgtggtggtgttttcatgtaagtttcctttgcctcctttcaaggagctgttatgcaaaagctgggctgtgccaccctacatacccccatcagaacaagggcctctgctttagcttcttctgtttgaggaagatgaaggttcatttcatcaccatcaaagtcagcattatagggtgtacagacacactcattaaatctgaaggtccggtggggcttgaccctggcctgtggaacacaaaacaaaacaaaacaggaagaggacttaggcatttatccaaaagcttctctgttttgaaacattaaaaatggcttcctggaatactgggcactggcttaagaaagtagatttccagtatgttctgtcaagtgatatatatcatttaggactcattcccagtctggccaacatggtgaaaccccatctctactaaaaatacaaaaattagccaggtgtggtaacacatgcctataatcccagtaacttgggaggctgaggcaggagaatcgcttgaacccaggaggtggaggttgcagtgagccaagatcgcgccattgcaccccagcctgggtgatagagcgagactccatctcaaaaaaagaaaaaaaaaaaaagactcattcgagaagctttattagattgaaccaaagcagtgaatttcaacaaaggcgccagtgtgaaggctcccactggccaaggatgtcatggtttcaagtatcaaaaagattaacagcagaagttgattaaaataaaccaactaaataaaaacccatgtgtttataatgacactgaaaaaacagaaagtcaaaacaaacaaaaaaccccaatcaatctagttggaagttactgagcactaaccccctttttttttgagacgtagtctcactctgttgtcctggctggagtgcaatggtgcaatctcggctcactgcaacctctgtctcccgggttcaagcaattctcctgcctcagcctcctgagtagctgggactacaggcgtttactgccacaccaggctaatttttatattttagtagagatgaggtttcaccattggtctagaactcctgacctcatgatccgcccaccttggcctcccaaagtgctggcattacaggcttgagccaccgcacctggccctttctttaaaaaaaaaaaaattttttttcctaagcacacgaacacaggagagcactaagttcttacttcccaaaatcacaataaaggaaaaagacttaaccatttacacagcctttgctttatgagctgcacctctgggcaagcaaacagacctaattaacaagcgggtattttccattataagaattgtaggtaataaatgttaaaggaacgatagattcaaaaagtggggttccattttgcagcccaataaaataacacaggcaatgataacaaatgaattaattagaatgaattcattgcttgcatcttgactcaaacaaaccacaaaaagacaattttgagacaaatggggaaatctgaatatgaactaggtatggacctgggaatgccaagagatgactgttaattttgttaggtatgattacagcactgtggttatgtaagtttttcttacaaatgtaaactggatacatattgaaaaatgacacagatatgggttcatcgaagaaaaatgggaaagataaaacaagtgtggctaaaccttgaaaattattgcatatagaggatgggaatatgtaagttcattagaccattctttctactttagtgtacatttgaaaattttctttttctttttttgagacggagcttcattctgctgcctaggctggagtgcagtggcgcaatctcggctcactgcaacctctgcctcctgggttcaagcaattctcctgcctcagcctcccaagtagctgggattacaggcacgtgccaccacacccggctaattttttgtattttagtaaagatggggtttcattatgctgtccaggctggtctcgaactcctgacctcaagtgatacaccttggcctcccagagtgctgggattacaggcatgagccatcacacctggcctcaaaattttcaaacaaaaaaaatttctacttctttttttagagacagggtctcattacgttgtctaggctggagtgcagtggctatttataggcgtgatatagcacactgtagccttgaactcccaggcccacgtgatccttctgcctccgcctcctgagtagctggggctataggtgtgtgccattgccagtcaaaaaaacctaataattatattttgtaatgttccaaagccaagcaaaacattccagaaagagaaggctttagttaaccctctacattctcacaatcataatcccataatcacaaactacttcttagttatttctactattatgtaaatgactgatataatgtgttcagacgaccccaaaatgaatctatgaaaaaatattaccataagaggctgcttaaacactgtttgcaaaggctcatggattaacagctttacagataggagaatctatgaatattgaacaaattaaagctgtatttcatttccattttaaatctccagaaaaaggaactgctgctgttgcaaaactaaatcaccaaaaaaatatggtttaaggtcttagttggaggattactgcaaagaaaaaatcttttaagcattttagttgcttagttaatatgcaaagttaaatcaaaagtcaattttctggctaggcacagtgggtcatacctataatcccagcactctgggaggctaaggtgggaggatccattgagcacaggagattgcgacccatctgggcaatacaccaagacctcagctccacttattaaaaaaaaaaaaaaaaaaaaagggtgggcacagtggctcatgtctgtaatcccagcactttgggaggccaaggtgggtgaatcacctgaggtcaggagtttgagaccagccaggccaacatggtgaaatcctgcctcaactaaaaatacaaacattagctgggcgtggtggcatgcacctgtaactccagctacttgagaggctaaggcaggagactcacttgaacctgggaggcagaggctgctgtgagccaagactgcgacactgcacaccagcctgggcaatagagtgagactctgtctcaaaaaaaaaaaaaaaaagctggccatcatggcacatgcctgtagtcctagctacggtaggctgaggtgggaggatcgcttgagccgaggcggtcaaagctgcaatgagccagactgtgccactgcactccagcctgggtaacagagtgagactgtctccaaaaaaaaaaaaaaaaaatccattttctgccatacctattttatgtaagtttgtgcacacaacacatatacgtgtatatgtttttgtgaaaccatgctagtcactttcaattaaatcctctcttagtgttttgtatgaatattacgttgcaaatattaaaaatttaatattaaaaaatattaaagcttactaaaaggaagcttgaaattaaaaagtttcactcaaactaaaatgtgagagaagagggagaccaatagttatgaaaggttgggccagctgtaggggctactcacgcctataatcccagaactttgggaggctgaaggaggatcgcttgagcccaagagttccagactagcttgggcaatatagtgagacccccgtctcaaccaaaaaccaaaaacaaaaaacaaaaaaaccccaaattagccagatttggtggcacatgtccgtggtcccagctactttgggggctgaggtgggaggcttgcttgggcctgggaggtccaggttgcagtgagctgtgattgtgtcactgcactccaacctgggtgacagagcaagagcctgtctcaaaaaaaaaaaaaagttatgaaaacttgagataacaggcaattttaattttagaagtccactgtttagcactgaacagtcatggcaaatttctacgtgatggaaaatttaaaaagcagtgctactcaccagatgagccataatgctcaatttgtgcagcgagggctgccgattgaacagcaccacatctccatcgatgaggtgtctctctacgatgtcaccatacttgagctcttgagccatcttttctcgatttccgtatttcaaaaacctgaatgtgcaacaataaacatgatctgtgaaagcaaagttctctcaccaagtttctccctcttcagatcaggattcaatctttaatatattatttcatcaaatctaagatgcctccattttaatgtcatatagttttatgtgccaagaaaaaagctccctattaaactatgacagggtgggcgaggtgactcactcttgtaatctcagcactttgggaggctgagatgggcggactgcttgagcccaggagattgagaacagactgggcaacatggtgagaccttgtctctacaaaaaatacaaaaattagccaaacgtggtggggtgtgtgcctttaatcccatctactttggagcctaaggtgggaggatcacctgagcagaggaggtggagactgcagtgagccatgattgtgccattgcgctccagcctgagtgacagactgagacatcaaaaaaaaaaaaaaaaaaaccatgataaattgatcttaagatatatccagtcggatgtggtggctcatggctgtaatcctagcactttgggaggctgaggcagctggatcaccaggtcaggagttcgaaaccagcctggtcaacatggtgaaaacccgtcgctactaaaaatacaaaaattagtcaggtgtggtggcgggtgcctgtaatcccagctactcgggtgactgaggcaggaaacttgcttgaacctgggaggtggaggttgcagtgagtcaagatcgtgccactactctccagcctgggtaacacagcaagactctgtcttgaaaaaaaaaaaaaagacatatcctaattttagaaatgctaaaagccctgagagcccaggtgacacaggcaatgatccactttatatatttattgtatttctgagacagagtcttgctctgtcgcccaggctggagtgcagtggtgtgatctcagctcactgcaacctctgcctcctgggttcaagtgatttttgtgtctcaggcttctgagtagctgggactacatacgtgtgctaccgtgcccagctaatttttgtatttttagtagaaaaggggtttctttgccatattggccaggctggtcttgaactcctggcctcaagtgatttgcccaccttggcctcacaaagtgctgggattaaaggtgtgagccaccaagcccagcaataatgatcctctttagactttagtatccatggtattttgtcctcctggatccaataacattacaagcctgagaacaaaggagcacttcatgtatattcaatgactgaacagagcaaatgacataccttggctcacggaaatttaaacagatattttccacatgccaaaatgtcacgcaaactgtatttctggattgcattctgtggctgagtatgaccacagtgagctttgccatgagaaagtagttaaatccaactagattgggaaaagattaccttttcatctgcgtatgtctctgctgaatgaagtttgctcctgggtgaacctcagggccgttttgaaccagtttcctcaagaaattgatgtttgctttgtttacctgcagtacaaaaaaaccacaataagttactcccaggtaactagaaactaacaaatgatactgaaatgcgtcttaatctttactttccttgttcagattctaggagaaagagaggcatcctgggcagcctgctgcctatggtcttgagtataatgtgaacaacagactggcaaacaagcttccagcttccagtgtcaactcagctgtttgctcactgagtgacatggccaattcctttcctggtgcttggtttcctcactggtaaaacgggtaggctagactgatctataggaaccttctgtgatcctagaaacaggtggcgacttgatctgcaataacttactgggggcttgtaaggtttaaaagttgtgacaccagcaccacaagccctggtctgcattgaatgtgttctggaacctcttaaacaactgtcttgtggaacaccattttggagaagttaactcttggatcattagtaactcaactgaggacacacaacacaagctgaccaggaacatctatgatctgggctaactgtgagtctcataggtaaagctaatcaatattctcgttagcaggccctgcagttacctagacctcaatttaaaaaaaaaaaaaaaagtatgggctgggcatggtagctcacgcctgtaatcccagcactttgggaggccgaggtgggtggatcacttgaggtcaggaattcaagaccagcctggccaacgtggtgaaaccccgtccctactaagaatataaaaattagctgggtgtggtggtgggtgcctgtaatcctagctactcaggaggctgaggcaggacaatcacttgaacccaggaggtggaggttgcagtgagctgagattgtgtcactgcactctagcctgggcaatagagtgagactcagtctcaaaaaaaaaaaaaaaaaaaaagtgctagctgggcacagggccctgtaatctcagtgactttcagtgacttgggaggctaaggtgggatgatcacttgaggccaggagttcaagaccagcctgggcaacatactgagaatcccatctctaaaaaatttttttaaaaaattagttaggcatagtggtgtgcatgtgtagtcctagctactcgggaggctgaggcataagaatggcttgagcccaggagtttgaggttacagtgagccatgagcacaccactgcacttcggcctgggtgacagggcgagagtctgtctcttaaaaaaaaaaaaccaggccggatgcggtggctcatacctgtaatcccagcactttgggaggccaaggcgggcggatcacgaggtcaggagatcgagacgatcctggccaacatggtgaaactccgtctctactaaaaatacagaaaattagctgcgcatggtgatgggcgcctgtagtcccagctactcgggaggctgaggcaggagaatggcgtgaacctgggaggtggagcttgccgtaagcagagatcacgccactgcactccagcctgggcgacagagcgagactccacctcaaaaacaaaaaataaaataaaagcctttctgggtatgtagcaatagccttaaaatgttcaaatgctttgactcagtgactgtaaagttttaaaaataaaaaatctatcccaagaaaattaactatggataatgtttaccatttagttagtttaaaatatgaggcatgaaccaacatagaaaagtgtctacttttttttcttaaagatggtctcactctcacccaggctagagtgcattgacgtgatcttggctcacaacctccaccttccatgctcaagcaatccttccacctcagtctccccagtagctgggaccacaggcgcctgccaccactcctggctaattttttgtatttttggtagagacaaggtttttactgtgttgcccaggttggtcttgaactcccgggctcggatgatccacctgccttggcctccctaagtattgggattacaggcattagccaccatgctcggtcaagatgttattaattggaaaaaaagttgcaaaaaagtatagcatatatatgagtaaatacacatgaaactagaaacaactgtggctgcaaatggtttacagaatatataccaccaactatgtataaagcaaactgggaagacacatacactcatataaaccaaactgtgggttgagtgggttactggggactttctactgcctgttgtttgcaataccaaaatataacgtaaaagactgaatttaaaacaaagaattgagcagctgagtggtcacttaccttctcaggaaaagttagaattttggccacatgaactggcacagctacctcatcaatccggaggttggggtcgggcgagatgactgttctgccagaaaaatccactctctttcctgagagatttcctctaaatcgacctaaatagccaaaaacatgtcataggtccccatggcataccatgtgctcatgggaacaataagaacggagagactgaggaaagcctgtgacctccaatcagagaagctggacagacactcctgaaaaaggaaccaaagagagtgggctggcttctgcacatcttgtgggaaacctaccctgttttcccttcaggcgttggacgaagcctctggtccacttcttgggtgccatgttgaggggaatgcccgagagctcactgttaatgtagagggcacactgcagctgcaggaaatcccagtcctccatgatcatctgggtcttggctcctgagatccgatgctaaaaccagcacagcccaaacagaaacaaacctggtcagtttgatttttctcacattttcttgaccagaagtttttggatagatatactatgaaacttacaaggaaatgggaggcactgacctttttaataacatcgtttaggaaaatgatttctgtcagtttcattgtcagatcatcttcattggtgccagacttcaaatcactcacaacggagggtctgatacacaaaggaggcaccaaaagtcgtgtgagaatcaaatcagacggctttccggcttctgggttcatcagaagtagaggaacatcttcagctgggattcgtttaaataaattcagaactactaagggattcaagttttcctatggaaacgaagaaaggcagaaatggagatactatgttagttttccatagcttgggcaaggttttccttcactatgttttctaacctatctgtcactaaggataagtgacaacagagatttctatggatgatacgctatgctgcaagagccttaaaattgtgtatgtcttttattccaatttttcaagccaaaaattccacttctcattattccaaggggtgtaacttcagaaatgaacacaaagatttagctacaagaatgttcacaaaagctgttttttgttattttttatccgtgtgacagaataggaaggtaataaaagctgttcttaacagtgaaaagttggaaagagcctgacagtttattggctaaataaaatcacggtatatccctatgtggaaaagcagcaagccattggggggaaaaaaagatactagacaaacacagcaattgacataaaaaaggtccataaaatattggtagctggaggctgggcgtagtggctcatgcctgtaatctcagcactttggaaggccgaggtaggtagattacctgaggtcaggagttcgagaccagcctgacaaacatggcgaaacctcgtctctactaaaaatacaaaaattagctgggcatggtggcacacgcctgtaatcccagatacttgggaggctgaggcaggagaatcacttgaacctgggaggcagaggttgccgtgagccgatatcatgccattgcactccagcctaagcagtaagagtgaaattccatctaaaaaaaaaaaaagtgttactggctgggcatggtggctcatgtctataatcccagcacttagaggggctgaggcgggtgggtcacctgaggtcaggagttcaagaccagcctggtcaacatagtaaaaccctgtctctacaaaagtacaaaaattagccgggcatggtggcgggcacttgtagtcccagcaactcgggaggctgaggcaaaagaatcacttgaacgtgggaggtggaggttgcagtgagcctagatcgtgcaaccgcactccagcctgggtgactgagcaactctgtctctaaaaaaaaaaagtgttactgttaaaaaagaactaaggtaagccaggatgcagtggctgacacctgtaatcccagtactttggaggctgacgcaggaggattgcttgaacccaggagttcaaagcctgggcaacatagcaagaccttgtctctacaacaaattaaaaaattgttgctgggggtggtggtgtgtgcctgtagtcccagctacttgggaggctgacatgcaaggatcacttgagcctaggaggtcggggctgcaatgagcctcgatcataccactgcactccagcctgggagacagagagagaccctgcctcaaaaattaaaataaataaataaacaaatatataaaataataataaaaaaaaagaactgaggtaaaaacacaaacaaggggccaggaatggtgacctatgcctgtaatcccagcactttggaaggctgaggtgagaggatctcttgggctcaggagtttgagaccagactgggcaacacagcaagaccccatctcaattaaaaacaaaagcaaaaacaaaaacaactggtgttacaaggccagtccacattagccttagtgccagataaacactgttacggtcaaataagaattactggagagctggccgggtgtggtggctcatacctgtaatcttagcactttgggaggctgaggcgactggatcacctgtggtcaggagttcaagactggcctggccaatatggggaaaccctgtctctactaaaaatataaaaattaggtgggcatggtggcacatgcctgtaatcccagctacttgggaggctgaagcagaagaatcgttttaacctgggatgcacaggttgcagtgaaccaagatttgcaccactcactccagccagggtgaaagagcgagactctgtcttccatctcaaaaaaaaaaaaaaaaaaaggaattatcggagagctgtcgaacctaactggacctctcattttggaagaaagtgggtgtctaggggtggggcggagttgggggagagagtgtgcatgtgacgtgcggaagaggcaggcgggaggcaggcggaaggcaggcgtgcattctcaggctcacctgtgcccttcccagcagaggctccacttctttattatgttcaatggctgtttcaaaagactgaaggaaatttgatacaatgggatccaccacttttttgttggtcttgtatttctcatgaattattttcagcagtccacacttctttacggtacctataagggttagtttatttaccaagaaataaaaaattatgttctcagattggccagagattgtagtatggttaatgaaattactgaaactactatagcaatgaaagatgagaggtccgtttcccaataggacatcagttgttgggctcttaagcctaatttataaggagaaaagctgactcccgaacattatgtaaacctaataaactaaacagaagacagtgagtgaaaagggctattgcttagccttctgtgcattccactcaccattaaaagcgccacagtgatggcagatgtttttcttccggcacttgtcagagattttctttttcagtcctcgcttctgaaggtaggtcaggccgggcctctttagatagtccagaaactgcttcttctcctcttgggacagcatgatgtggcagcaggttttgcagatcatctttttcaaattaagcaagacagataaaagcataagtgagaatgaaaaattattttcttttaaaaatgccatcgccctgttttgtacccttaaccacgtgaccatatacacagatctgcaaatggctctatactatggatatgcagagaggaagcctgtgttcactagattagcagtactcacagccagtaggcagactttgttacctttatctttttctttgtgctattctgtattgtttgaattactactattgttatttttttaagaacacgtatctaccatcttctcaaggtaaataaacaaaataaataattcttgagtgatttaacgtagtgtgagatgaaaatattatgtacttagtataaaagagtcccctagatgtatcccccaccactcacagttcctaagttcattccagcatccctgaccaatcactccagaatttatgtcttggaaatcagcacctgtgtgcttacctgtaagatgcctatgactgctctgaagtaccctacatgaaaacacggcaactccaggtcgatatacccatagtggcctagacagtcagccaagtttttcccacaggtttcacatggacgatccttctcactcgtaccctttgaaaaaaagcacacccaatgatcaacacagactgctggacgggaaagagtgcccagccatcatgcctggctggtgacacagaatcatttcttttgcttcttaaatttcctttctgagatcacttcctactgtttttctttcttttctaattttcatgactcagaatcgaatcaggttgctgactaaaggccggagttcttgacctagtctaatatgtgcaggggggaattgaggagatggaaggaagcccctgctcctttcaatctggtaagtcaccagttttatcagcagggcaagacacagttaccaggaggggtgagggggccttaccatcctatggtcgagcaccccatatagcaagggggcatgttggttgtcctggctgtacaggttcttactcacaacttggatgtgcgcctgctggcgcatctcctcaggtgacttcattccaaaacagatgtggcttctggaatgggaagaaaaaggtgaaaattacagcaaaatctgtgaccaaaaatgtctattacatacatagcccaccataaccaacctatccttccaactgtctccactggcttttcctaccagtattaaatatatttaaccctctctcatttttccttcacaaacatcccttcatcttactggaatccagtttctactctcaccatcaaaggaacagtgctcaccaaggccacctagacaacctgcctgctgctgaatccaataagaacttcctcattttacctctgcagcactggcagcaccctgcccaatcctgaagtgcttttctctcggctttggtgacaccatacactctgagttttcttcttcccttctctggctgctccttgtacagtctcttttgaggtcttttcttctactgctatcccttaaatattggtgcactgtaccacctagcattacaaccttcatcctcttatcttctcatcctacacattctcctgagtgatcatgccactcacatacatgttgatgtctatcaaatctatctctataggccagctactgctacccaactggacatctgtatagacacctcctcctggacagttccacctagatatctcataggcacttcaaaccccacacattgaaaacagacctcaatactttttctcccatgtctgtcccttcattcattcttccaacaaattgactatttcctatgtgccaggcaccatcctacaggctgaggatacagattagctaagacagacaaggtccttgccaacaaagagctcacaggtcagggtgggaaagacagaccacaaacaaacgaatatacaaatgtgaacagatgcagaagtgatgtaagcagtggagtctgaggaattactttacgttgcatggtcagaaagcctcactgtaaaactgacaatcagaaggaagagcatctgaagtggagagaatgactagggccagggtcctgggactggcacaagcttggcattttcaaggaaccaaatgaaatcagtatatactggagcatagaaagctaatagtacaagataaagtcagtgaagcatgcaggagctaaagcatgagggcttgggaactttggtagggaatttatttaaataacataaatgcagccgggtgcggtggctcatgcctgtaatcccagcactttgggaggccaaggtgggtggatcacgaggcaaggagattgagaccatcctggctaacatggtgaaaccctgtctctactaaaaatacaaaaaatttgctaggcgtgatggcccacacaatggaaagctgctagaggatttttttttttccctgagacagagtcttgctctgtcacccaggctggagtgcagtggtgcgatctcagctcactgcaacctctgcctcctgggttcaagcgattctcctgcctcagactcccaagtagctggggttacaggcatacaggcatgcgccaccgcacccagctaatttttgtatttttagtagagatgaggttttaccatattggccagtctggtcttgaacttctgacctcatgatctgcctgccatggcctcccaaagtgctgggattacagacgtgagccaccactcctggcctctgctagaggattttaattgacaatacccttaatttgcactttgacagaagcactttctctgttttgtgagaatgtattatatctgactgggcgcaggtgtacaggtgggtgtgaagggccagtgtcgatgtagagctaccacatgggagaatgctgcattcacctaggtaagacacctgttctagtgaatggcaaccatccacacagctgcccaagcaaggcattctgtatatccgtctcaaggtctctcgacctctaattctttccaccatgaatcaagagattttccagaaggagaactcttatcaagatactctcctgttgaaaatccttcaaaggttcctcactgcctacaagatgacttcttaacacagcttcaagtcttctgcttccttctgatcacctgtgttctctccctcaggtctgctccttgaaaaaagcagtttggtctgctttcttttgcctggacccattatgtgctctcaaaaccccctggacctacccttgtcattgcacttgtcgtacccagtgttgacttgtgtaccttctccaactagattaggcagtaaaagttttattcagaccgtatctttaacgtccaacactgggaataacgcgcagtatcctcctcagtgtctgctgtaagaatgatgaattcacttttttttttgagacaccgtctcactctgtcactcagggtggaatgcaggaggttgcccactgcaacctctgcctcccaggctcaagtgatttttcggcctcagcctcccgagtagctgggaccacaagggcgcgccaccacgcctgctaatttttgtatttttgatagagacggggtttcgccacgttgcccaggctagtctcaaactcctgagctcaggagattcacccgcttcggcctcctaaagtgctgggattacaggagtaagccaccgcgcccggctggattcactttcttaccgagaactctaagaaggagccaccgcctaataacgtatttctgaaggcaaaagtccggatagcagctttatttctgacactgccatccgtcggcctgtggtacagctttctagtgggcaaccccatccttttggtaagcaactactgcctccgtgtcagacgctctgcggctgacagaattagagacagtccccgccccagattgctcccctcgctgcagcaggggatagttcgctgaagaacagggatcattgtatgacttcaggagaatgcgagctttggcccagggtgcacaaatcattaaggctcaggccactccgacttctccgcccaagtccagggacctctcgaggtgctgaaatcccctcagcctgaccaatgctctttgaccaacgctggtagttctgggcgctggtcacacctatggactactggccctccccttcccattgcaccccatctctgaccctgcaagacccgggaccgctgacctcggaccccttgccctatttctcagccctttggccactcttactccgtcttacattttcttggccacatccgtctcccggaactgctccttcaccatgatgaccgctgccgggacgcctccttggcactcgggaggccagattagagaaacgatgcccccagcacctcctggggctgcttctggactcgccgctaacacatctgcggcatcctctcggccaccgtagagt

SEQ ID NO: 2534 - DNA, 1619 bp, Homo sapiens
ttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcg

SEQ ID NO: 2535 - DNA, 1619 bp, Homo sapiens; identical to SEQ ID NO: 2534

SEQ ID NO: 2536 - DNA, 1619 bp, Homo sapiens; identical to SEQ ID NO: 2534

SEQ ID NO: 2537 - DNA, 3015 bp, Homo sapiens
cggccggggcgcgccccgaggccgggctccagccgggcatgctccccctccccctcagcctccgcgcgcgccgcccgccccgcgagaaaactcgccccgaaagccgggccgcgcgccgcccccagagcaagactacaactcccgggagaaagtcgcctgggccgtgtttcccaggctcccgacagctccggcccggctcggaggccgcctcggcccccgtgcaccccggcccggctcaccggggccccgcggccgccacccgctcccccgtggccacagccccgccgccgccggcccgtccctcctctctcccctccccaggccgtccctccgggaggcggcagcaggggaggaggggacgggcggaggggaggggtccccggcccgcccgctaggcggggacgcggcgccggctggttcccggtcccccgaggcccaggcgcagccgggggtgggggacacggagtcaggcctggcacgcggccagcccacaagctgctggagaccccctcatacaaatcttgcccccagtccagagggtcctaatctgagaactccaaaatacagcctggagacaaatggtggggagggtttcccctaaatttggacatctccagattaagacctccgccgaatccgtgaggctttccctctccaaggagctcctaagagaatttcccagtaaaatcgcctcaactgcggtaaataggctgttccccgcgccagcatttgagaagagctggtccccagagtgtaaaggagttaggatgttggcaggaggaaggatgtgtcgccggatgaggaaaagaaaggtgggtgtctgcggtgcagtccttggtctttctggcaagtgaggcgctctccccctaaatgtctcagagggagacaaatcagcggactaccttgcttcctttgatgacttggaaaggatctgcagtcccccttaaagcccaagaatgtcttctcttccacgacagccgtttgtggacacatactgcttacctccctgactgcaggacaaggtccttcaaagctggaactctgactgcgctcagtgatcccgcagtgctcctctgtagagtgggaacccaggtccatttcaaatatctacgttggaatgagtggatctcgctgggggtgagaggcactttgtctacccacactgccagtcccagccacatgcctcctcccttccctcaaaaagcagtgtcttcttagtctgcttcttcaaggggagaagtcgtttttatttatggaaacgaactcactatatggtagaaagaacaagagtatcagaatttgcactttggacttggactcccctctaagcagctgcacaaggtggaacaaaccaataatccttgctgatctgttttgtccttaggaaaaatggtggagggagaatattagatcaggggttcttagccttggcttcatgaataagctcaaggatgtcaatgaagcttttgacatgatctcaacttttttgtgaacatttatatatttttctggaatggggtccatagagttacaagttctttaagacctccagatggaccccaatatggcagaaatgaactatttaaagatacctgcctgctcccgtagtctgaccctctatggctaagcaaggttttagaggagtggaaggctggccattgcacagtatcagggttccagacaggctccctggctcttccctcccagtcctgctcctgagatatagttctttctggccgccacttcccttagggcaaccccagagcttaaatcatctgcaaggcagtcacctttcaggcacctttcatccggcacctgtgttcttagctggattaactagaaagctagttggaggaaggaaggtgaaagtggaggaaggggaaaagaggaaaagttggagacgaatctggcttatggttagaagcatattttttggccaggcaaagtggctcacgcctgtaatcccagcactttgggaggctgaggtaggcggattgcctgagctcaggagttggagaccagcctggccaacgtggtaaaaccccgtctctaacaaaaatacaaaaatttagccaggcatgatggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 2538 - DNA, 23055 bp, Homo sapiens
caggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtcatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgtgaaggcagaagggttgaggttgcaggaaggaagggtagtggaatgttttggagaaaagatggtcacagcccctgcatggagcacctacagacaggagggcagggctgagaagagttaagtcatggggctgggcctgctggccagggggtggttggagttctgttttcatatctacagaggctgtgtacttcggtttgtggggcctctggccctgtaggttctcttgctaaggaatctgctactactttgctaggaccaggaaatggcttactagtacagaacgtgtggaagaatggggtctttgatgtgatttgacattttttgatgaacagtgcataccaggctgaaggtaatgctaggggcagcaaaggttggggtttgagatgcagtttcctgtgactgagctggagtgtggaagcagagaaggcaccctgtgagcagcttgcagaggcaaggtggtgaggatcctgacagtgctgcagggatgggatgggatgggatgggacaggacgtggagctgggggtggttgctaagttgatgcagggagagtggaaggaagcaattgagaactgaagggtaggaaatagtttctgatgtgaagaaaaagggcatagctgcagagagcctgaatgattgaaggttggcatcaaagtcacgaagtggggaggcttttctgttcagctgtgctcagggcagaagttgtagtctttcagccagtagccttgggaagggaggtgggatgaaactcaggcttggcctatttttccagaggatccacttgggttgtgatattatagaaaatgtggcagtcttgctgtgagccttgttaggcataacatttggaaacttggcaaattttacgtaaaggtctggatttccagcctcttgaaataccagaagcagcagtagtagcccaccttcctgtttgataacaattggcagggctccaggctggctgcatctgttgggacaggtattctctggtctccacagcctttgctcctacggccagctaacaccctcctctacctgccctctggtcttctgtccctgctgcctgcttctcttccatctagtccatccaagtgttttttggggaagtcacctggtaccttgttagggttaatttgtcttttaaattgggctcccaagggtatctgctagctaccctggctcacaaggctattttgaggctgaggatgtaacaactgtgaaaacagtttggaaactagtgctaagcaattgtttgtcaggaagcagggacttgtgggaactcaaactgtggacagattcagcacattgtaggccctcacagtaaccaggctaccctgtgctgtcagcaggctttggaagagcctccataaaatgcaaacttgactttactaagctgaatcaatattgagggagcacatcccttccttcagcttgtcactgatgggaagctgtggcttagagagagcagggatctttgaagagtgatgagaaactcagctagaggtggttctgggaaggtacctgcagtgaatatttggggtgctgctttttagcttttcctagcaccacaaccatgagttctgtttgtagctggatgtgcctatgtaatcaggcagctttcaactctgcactcttcctttcttccctggcaagttgcttattttaggctgcccttaaagacagcatcttacatggtgctctcatggagccgaaacaggtgctgtcctaaactctgaacaacgatctccattaatctgcgcgcgcacacacatacacacatattttttttgagatggagtctcactgtcacccaggctggagtgcagtggcagaatcttggctcactgcaagctctgcctcacgggttcacgccattctcctgcctcagcctcccaagtagctgggactacaggtgcccgccaccatgcccgggtaattttttgtatttttagtagagatggggtttcaccatgttagccaggatggtctcgatctcctgaccttgtgatccgcctgccttggcctcccaaagtgctgggattacaggtgtgagccaccgtgcccggcctaatctgcatgttaactccaagaagcatgtcttcctggacccacgctggaaagggtgtagagcagttaagcatcttaccagtgtctcacccatgaagtggtggggatgggattggaatgcagtcatctgactccaaaacactgcattttttcaggcactccagtattaagctactttgcactgtgcatataatggtatataaaactcatgactgccagcagggtgccagttgccatgggtttattgaacaagtgttagatggctagccaaattcccaatttactgaccacctgctgtgtccctgttctgcaagttggggataaagaagctgttctgtcttgaaagctctgaggtagttaatgacgatcccatgatctggcttctgttcctttctgtgaagtagcagatagtgtatgactgtgacgtgatagaaattgagagccaagaagatcagtgcagggaggctgggtcttggaaggcttccaggagacatacagcagtccccacctatctagtttcagttgctgtcggtcaactgcagtctggaaaattatcatggctaaatggtctgggatcacccaaaagtgatgatcctcttgaagtgtcatcagaaggtcaatagtagcctaacacgtcaccatgcctacgtcatttacctccctctcccttccacataggcattttatctcccatcaagaatgtgaatacatgtacgtattcagaggaaaagagttcatgcagcctactacagtataattattaatatcttactccctaaattatgaactttaattatgtatatatagcaacaaacttggtgtagatagggtttgcggtttcaggcatccactgggggtctaagaacgtttgccccatggataagggaggattactgtaacaccagcagtggcaagagacatgatctgatttggatgcacaggagaaagttctcatttgaggccatgaaaaataggaaagaaagcagggagatgggagcaggcagtgtgggacaaggtgagaccagtcattctgcaaggggaagagaggatgacactggggaggtgggagcagagtgggtaggtaggcattctcttgaatcaacaagatggaaggccctacatgactgatgcctttgagcagagttttgcacaatgcatttctggtgggagatactccatttcaaaaatagtcttcaggttggctgctagagcacagaagtatgacacctgactcatttgtgctggcagagaggctctcctgggttttagagctttgtgaacacacctccatacattaatccaactgtccttccccatccactcacccttgaacttcccgcatgccagatgttgaggggaggcagaaatgagacctgcctcccagtgcccacagtctggatgagagggtacaggtgaggtcctggtaagaaacgaagctggagaggtcagcggagaataaatcagggaggatcttgtatgccaagctaaggatttcacttgttcagtgttttggttaaagaaaataaaacgttggagaattagatgttctgcagtggattgtgtgttcttttcacatgccgagttcctccacacaggaaatactttggcaacgctctggctgctcatcatgcatattggagagggaatttatgtagaaggttatgggtcgatgagatggcatccaagtatttatcgtatttttttgagatggagtttcactcttgttgccccggctggagtgcaatggcacgacctcagctcactgcaacctccgcctcctgggttcaagcaattctctgcctcagcttcccgagtagctgggattacaggcatgtgccaccatacctggctaattttgtattttgtagtagagacggagtttttccatgttggtcaggctggtcttgaactcctgacctcaggtgatctgcccaccccgcctcccaaagtgctgggattaccgtcgtgaggcaccgcgcctggccccaagtattaataactcggaaaaagggaccagatcaggaatcaggagtcacagttcctgatctccactcagcttacaatcagctggggccatggatgggcaaaagacttcccttttctgggcttctatttccctccctgtgtctgtctgctatccgggctagatgagtaattccgaaacctggcaggtgggggctttctttttttctttttgtgagatggagtgttgctttgtcacccaggctggggtgcagtggcactgttttggctcactgcaacctctgcctcctgagttcaagcgattctcctgcctcagtcttctgagtagctggaactacaggcgcctgccaccatgcttgggtaattttttgtatttttagtagagatggggtttcaccatgttggccaggctgggggcttgttaaaaatacaaatgctggctgggtgtggtggcttatacctgtaatcccggcactttgggaggctgaggcgggtggatcacttgacgtcaggagttcgagaccagcctggccaacatggtgaaacatctctactaaaaatacaaaaattagctgggcgtggtggtgcgtgcctgtaatctcaattactcaggaggtggaggcacgagaattgcttgaacccaggaggcggaggttgcagtgagccgagaccatgccactgcactccagcctgggtgacagagcgaggctctgtctcaaaaacaacaaatgcccagcctcttgccccagttttcagagttagtagatctgggtagcgcccaagcacctgatgttttaatagcttcccaggtgaggctgcttcaggaaactggactgaagcttcccaggtgagctcaggcttgggaagctggactgaagtttctctaagatccgttctgcctctgagaattctgtctctaatgggaatactgtctctgccctcaagaagctggcagatgaacagtaatactattgctaattaatgaccacagaatagctaacatttattgtttaccatgtgccaggtactgagctaagtcttgcacaaattatctcatttacctttttttttttttttttttgagaatgagtctcgctctgtcacccaggctggagctctggattgcaccagtggcgcaatctcagctcactgcaacctccaccttctgggttcaagtgattctcctgcctcagcctccatagtagctgggattacaggtgtgtaccaccacacctggctaatttttgtatagtagagacagggtttctccatgttggccaggctggtcttgaactccagacctcaggtgacccacctgcctcagcctcccaaagtgctgggattacaggcatgatccactgcacctggcctcatttacctgcactcggagggaagtactattacccccattttatagatgaggaaattgaggctcaaagaggttaaggaacttggttaaagttacacaactatggcatcctatgataagcctgggggcatttgtggaacatcttgccaaggagctagaaatggtcctgagccttaaatgggtggaggtgattagctgaggcagcgattctccaggtgtggtcctggacagcagcagcagtgtcaccagggaacttgctagaaattcaatttcttgggctccaccctagaattactgaatcagaagctgtgggtggggccaggtaacctgtttttttttttgagttgcccaggctggagtgcagtggcgtgatcttgcttcactgcaacctccgcctcctgggtgcgattctccacctcagcttcctgagtagctgggactactggtgcctgccaccacgcctggctaattttttttttttttgtactttttagtagagatgggatttcaccatgttggtctggctggtcttgaactcctgacgtcaggtgatccgctggcctcggcctccaaaagtgctgggattataggtgtgagccaccgcgtccagccagaacctgtgttttgataagctctccaggtgattcagatgcatgctaaagtttgagaaccactgagcttagggaaggggaggatattccagagggggacagctgtggagacccggtaggacagtgctgtagactgccccatccctgccttttcacttggtgaaataaagacgtgtgatgcactatgcagactcccacaagggggcactgtgggcacagacgtggaagcggtctgctttgttgtcaagaccgctacccttgtggaagcatgaaaaaagcttgatgccagatcaactggagaggtcactctttcttctcagagaaggtctaatgggggtggtaatcttgtttataggattcggccctcgtagggaagctgaacctggagggctttctgctgttcatatgtgcatggtgatgtctacccatccgtgctgcgaggtctctgcagatcctgtgcaaacagcattcccccttttgtagctgcccagccaggcagcttgcggtttctattgggggaggtgggggccgaaggctgggaaccccagcagcccgattctgcttcagccttctgcctacagtgctatgcctctgtcctattctttgacaagcatgggtccggggccacagtgctgggtccaagacctgttttcaagccttagctctgccccaccacactttaagatctctggcaagacccctttctcctctgggtctcagtttcctacactgtaggatgagagagtggtgctgagaaagtggctgtcaacatctctttccactataaaattctgccctgggagttgaggaagagactgccttgtgcttttcaaggacctcggattgcaggggatctgtaaaccctgctacatgacatccatctccagtagccacttaaggaagcatttccagggatatggtgcaagtcagtaaggtggaatctctcaaacaagattttttaaaaagtccatatcttcagacatccagaatttgcttttataggtttctattctgcactgtttggaagaaggaaaatttataccatgttctcttttctgctgcagtgtgtatttcttccaaaaatacattgcctcggagggtctttggcattcacctcgttaatccagggattggcatcctatactctcggtgactgctcacccagctgagccactgctctgcctgggcaggaaatctccagaactgccttttcagagcgctatagatgtgctcatccctgggttataaggggattcaaaagagtggtccagccctctgctggctcccaccgtcgatgatgatattcagagagtctggttagaaattgcccaacccagccgcgtgcggtggctcacgcctgtaatcacgttgggaggccaagatgggcagatcacaaggtcaggagttcgagaccagcttggtcaatatggtgaaaccccgtctctactaaaaacacaaaaattagccgggcatgggggcatgcacctgtggtcccagctgctcaggaggctgaggcagaagaatcgcttgaacctgggagagggaggttgcagtgagccgcgattgcaccactgcactccagcctgggcgacagagcgagagtccatctcaaaaaaaaaaaaaaaaaaaaaattgcccaacccataggcaaacattgttaactgcagctgtccttggtggaggaaacaagttaaacatgatgtctctttccatcaggcctccttggagcggggaaggagagctcttcagttcctttggcaccttcacgcagcatgcaagacgggctgctttttcttctgtttatggatgaggcacagagggtagatgacttgccccaagtccttcagctcattcatgctggggaaaggagtaagcttcaggcgtcttcccctggagttcacgccacctctgacagcaagtgagccgtttgctactcaagtgctgtttcttgcttttttaaggtaacaaaacactgcatgctgtctggggtaccttttccctgctgttcagttcattgccctgtgtcgtctcacagagcgtgtcactggtacagaaatgttccctgggaagctagagttgaaacatcgcccactggtgctcctgagctggctttgtcatgggtttagagggtatgttagggaggaggccttctgctgcaagtctctgagaagtcagcttacactgccttgaacagtgaggttgcttattagctcctgtaagaaccccctggatgcccaggagccttcagggttggtggacactgcagtttaacagcgtcttcgagggcctagacgttttctctctccactttgctgccaatgctggtgccattctgagggatagttgcccatcacagtggggctgggactgggtgaggcaatgaagcgcttagcatgtgaaatccaaggaggtcttcacccacagtggtgctagtgcaaggtcagcatctccttgaccctaagagcaccttgccctagtactggggcctgtgggaggccacccactctccacaaaggccagaccagaagtcacctgtgttttttctgctcctcttccatcggctgggacttagtctcctgcaacacctaataactgtgaggtgggctgggaaatataggcttgttccagctcaggcagatgtgggagcacagttttgggggacaatgaccagtctttgccacagcaggaagaaaatggttgcttcatagggatcctttcagcagaaacctcccagcaaaagggggaagtttactgggaagctgtgggtgatctaacaaagccaaaaggtaggcggtgctggcagcctccctggatttgggtctggaaaatcatttcagaacaaatcagctcttccttctcccctccttcctccttccccctctttgagtctatgcctctctctctctctctacaggctggcttttctttgttcccctttctgccccatggctgccacaaccaggattttattgctccccattccaaacttccggccagattagttagacctgcatcctccttgccacttcccagggacaagatgctgactggtctgtcagctcatggagcccactcccacttacctggggctgaggagcacctgctgggaaggtttgagggcaggagggctgctgatgtatccaatgcagccaccactcccaccgctgagacatctgtctttctttccttcttgtcactcccagacctcagcaagtggccgctttaaaaagagaataagagctttattgaggtttaattcacagaccatatattcacccttgtaaagtgtgcaattcaatgggtttcaatgtatttgcagagtggtgcaaccaccaccaccacctaatttttaaacattttgatttttatttggtctcactctgtcacccagcctggagtgcagtgatgtgatcatagctcgttgcatcctcgaactcctaggctaaagtaattcttccacttcagcctcccacataactaggactacaggtgcacagcaccaggcccagctactttttttttctttttttttagtttttgtagagacagagtctctacattatgttgcgcctcctggcctcaagctatcctcccaccacacctattcatttttgatcatttttattatgccaaaaagaaacccttagcccggcaggtgtctcatgcttataatccctgcactttgggaggctgaggcgagcagatcacctgaggtcaggcgttcgagaccagcatggccaacctggcaaaaccctgtctctactaaaaataaaaaattagacgggcatggtggtgagcacctgtaatcccagctacttgggaggctaaggcaggagaatcccttgaacctggaaggcagaggttgcagcgagctgagattgcgccactgcactccagcctgggcaacagagtgggtgagactctgtctcaaacaacaacaaaaagaaaccctgtagacattagcagtctctccctatttccctcaacctctgccccagcccctggcaaccacaaatctgttttctgtttttataaatttgtctattctggaaacttcatataaatgaaatcatatagtgtatataggtttttatgaccggattctttcactcagcctaatgtttccgtgctatgtccacaccgtagcatgtatcagtaatttattccttttaattaccaagtaacattcccttgtgtggatttaccacgtcaacatcagttgatggatatttgtgttgtttctgctttttggctattctgaataattttgcagctatgaaaattcatgtgcaagtttttgtgtggatgttttcacttctcttgggtatatacctcggggtggaattgctgggccttatggtgactctctggttaactgttttccacagaggcagcaccattttatgttcccaccagcaatgtacgaaggttctaatttctccacatccttcctgacacttgttattatctgtacttgattttagccatgcaagtaggtatgaagtggtatctcattatggttttgatttgcatttcataataactaatggtgttgagcatcatttcatctgcttattggctgtttatatgtcttctttagaaaaatgcctgtttgaatcctttgcttattttcaaatggggtgatttgtctttttattgtgttgtgttagtttatatatcctggatgcaaatctcttatcagatatatggtttgcaaatattttctcctattctgtggattgtccatttttaaaatttatttatttatttatttattttgagacagggccttgccctgtcgcccaggctggagtacagtggcttgatctcggctcactgcaacctctgcctcccaggttcaagcaattctcgtgtctcagcctcctgagtagctgggattataggcatgcaccaccatgcctggctaatttttgtatttttagtagagacggggtttcaccatgttggccaggctggtctcggactcctggcctcaagtgatccacctgcctaggcctcccaaagtgctgggattacaggtgaccgccaccacccccggcttagttcttggtttttctgtccttggaaactgctgtcagggttcccgagagactttgaatgtaacaataataccttccttttattgagtgcctactattcactgtgttgggcacattgtatatattaccttttgtcctggaaatagttttacaaggtggggattattgtccccatttcatagtgtgatgaggatgctaaaaaaaagcaaatgttgcctctagctgccgccatgggaggtaggcacctggagcgaaggcacggcaggttctgctctgccctatctccctttggaccccttctaggggttatgttggatttggaagccacgaggaggagtctactcagacaagagcatcctgatgggggctgccttgagatgatggggtgtaagccctgtttagctggaaatgaggagagagagacgtacccttggtcaagggctatcatgtgaaagaagggtaacatttgtcctggagtgtggagtgtgaagcatatggggaaatggtttgggctggatagcaggcagtttttaaaacttggagcaagccgggcgcagtggctcatgcctataatcccagcactttgggaggccgaagtgggtggatcacctgaggtcaggagttcgagactgtccttaccaatatggtgaaatcccacctctactaaaatacagaagattagccagatgtggtggagggcgccttgtaatcccagctgcttgggagcctgaggcaggagaatcgcttgaacctgggaggtggaggttacagtgagctgagattgtgccattgcgcttcaggctgggcaacaagagtgaaattccgtctcaaaaaaacaaacaaaaacaacaacaacaacaacaaaaaaaaaaaaagaaaagaaaaaaacctcggagctaatggaaggggcctgccccctgggaagcagcaagcttcctgttgctggtggtacacaagcagagcctggctgctttctaggtgaggtggttgtagaagctctttgggttcagagtcctgggggggttttagggtttccttgaatgcccagagcctgtatgtcatagcttctgatttcacagggacttcctgtccacgcagctgggatctctcccagcccagattcatcatgtctcacccatcctgagggctaaatttggaatttaataacaacactttggatttatgtggcccgtttccttggaggcattacatctgttatcccattaattctcctaatatctttgggtggaaggtgagggaaggtgagggagcctgagaggggagaaggaacctctttggcttcttcagctcctgaaggggagaggaaatggcagagcaggagcgggccggggatgggggaacgtctgcaccacagcccctctggctttcccctctcataaaaagcaggttgctcaccggatgaaggggtgtctcccagcaggaagctcctgtgttgggcacagtatattggtgcataagtctccaggtggactctttgagggctggaagtgggtagacatcaaggtgggcaagatgaagcctgagccctaagcttgggaggagaccaacatgtctaccacgaaccaatttgcagagctggatggtctggaggaagcagtatggcttcctggggaagggggatttgagctgagtttggaaagagtcctggagcaccctggagtccagtttcctacctcctagtcacgtggtgtgggtgaaggccataccttggtgagctttcccagggtatgggggtgcctagggtgctcctcaagatcctaaggcttggcctggagtgctgttgggcgaatggccagagagtctgggcaggcagaggagggctggggactagtgcagggaaggagccgctggcactggccatgaagaaggagtgggaagggaagggaagggtggcccaggtggagggctctgtggggcagaggcagattggtgtgggggttcttgtctactccagactatgctgttttcattcctgcctctgttctgaggcttgaactcctgcaggtacctggcttttacagccctcccaagtgcccttccttcaagctttggctctgactgctgctgatcttccctggtaccaagtgagggaggtgcagaatcccaggccacaggcgcagaacagggcggctggaaggcacctggacaatcctctgagactattctctccttcccgcttttgcagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccccaccttcctgcctctctggtctgggccactaatgtcactgccatggccgccttgctgcatttctgaggatgcttcatctctccaccttcttctccactcagcagccagcagggcactgtggaaatcggagtcacatgagctggcacctctgttcagaaccctccagggctccacatctctctcacccaaatgccaaagacctccccacgcccccacaatcccccacgacctggccactggcctcccaccaccttccagctccagcggctcctaccacatttaaggctttccttcctagttttaatttttcctcgtcagcagttgattttattattttcttgtttattggtattttcccactagaaatgaagctgcgtgaagttagagatttttttttttggtctgtgttcctaattagctcattgctatacccctggcgcccagaacaatgccttggacacagtacgcagtagactaaataaatacttgttgaatgactgactgacggaatgacggctgtgtggggagtggattgggtcgtgaggcagaggctgcggtggaaactcaggcaggaggtgatggtggttcttggggctgcggaatgccaagtttagaagctcttcctctgctgtggcacatgaaccggtcactcgagaaggcttttagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggta

SEQ ID NO: 2539 - DNA, 6957 bp, Homo sapiens
caggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtcatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaa

SEQ ID NO: 2540 - DNA, 6957 bp, Homo sapiens; identical to SEQ ID NO: 2539

SEQ ID NO: 2541 - DNA, 6957 bp, Homo sapiens; identical to SEQ ID NO: 2539

SEQ ID NO: 2542 - DNA, 6957 bp, Homo sapiens; identical to SEQ ID NO: 2539

SEQ ID NO: 2543 - DNA, 6957 bp, Homo sapiens; identical to SEQ ID NO: 2539

SEQ ID NO: 2544 - DNA, 10780 bp, Homo sapiens
tttcatctcatccttctaatcaatggaatccactgtgcccttttttctgaggaactccttctggagacaaactggccaaagtgaggagcagctcccggctacccctgtgagttttcagtggacgtgctataccccaggaacagcaaatcaccggcattcaggccaccacatcccatcggagccagtggcagacattgctaatcaaccacagcacagtggccttagacgctcaatgcggtgctctgggtagccatcaccaatcaatcgagatggaaccgattgccacccctggcatggtgggtgtccacgctggcatgcccagatgagtcctgaccttcggcccctggcagagccctgctgactaagcctcgggcccattagccagggcctgggtgagggcgtgagggccggcactgaggatgtgatgacggcctgagcccttggagctcctgtgcatgctgaccacgtcaccgctgctgggctcacgctctccgtgctggccgaagaggcctcggacggtggcctggaagccactggtgacgaagcagtagacgatggggtccatgcagctgttgaggctgctgagggtcacggccacgtggtagaccacgaggctcgtgtggtgtggcatgtcgggccacagcgccacggccacttggcgggcgtggaagggcgtgaagcagacgagaaagatgatgagcaccgtgagcaggagctgcatggcccgcacgcggcgctggcgaccctggtggagcagacccggccgcgacagtgcacacatgatgcggccggtaaacacgctgatgaccagcaggggcagcaggaactccaggacagtcagcgcaaagacacggcagcagggccggctgcctgtcacgcccagcaccgacagggtgacggcaccggcggccagccacacgaaggcgcacacggccctggcacaggcaggctggcggcagcggcgggagccttcgggccgcacgatggccaggtagcggtccacgcagatgcaggtgaggaagaggatggagcagtgcatgttgaggaagtaaccgaggacgtgcgggaaggcacagcgcaggcagcccctggcgccgtagtacacagcgaagcgcgtgggcagggacagccctaccagtagatcggtcaccaccaggttgatggtgtagatgactgagggtgtcttggcccgggtgcggcagcagaagacgtacagcgccagcccgttgagcaccagccctgccaggaagatggctccgtgcaccgccatcagcgccagccacaggcctgggaaggtgccatgcagctcctcgtccagccgggcaaacaggtggaacaggggcacctccagcccgctggcattggtccgcactgttgtcactgcggtggcattggggactgccccggccgagggccccgctggagacacagagggcatgacggcagccagcacaccccaggcctggaagcaaggagaccaggtcaccccaggcgccagcctggccttaagccctgccctgaggcccagaactcagctggcccgtctgcccctgcacgcccagcatcccccttctccatgccctcgcctggctggggcctcaaatgcctgctcccttggctctacccagagggagcctcggacagcagcagaaaaggcacaggctttcagagtcagacgcgtgttcaaattccaggactggcacttgccagcgtggagactcgacaaaatacggaggtttctgcgaccgtcctggcacgagggggaggcggaaacacgtgcggtgcagggctgtcctcgggatggagagctgataagggcaagaccacggggctccagtgtgcagttccagggcctggctccagccccagctgtgccactgactagtgtgcttgctcgggtaggccacttaacctctctacctgcttcctaatccatgtcactgggatcgcgttgctgctggggtgactaagcaagcgggtcagcacggcagcgccagcagagttggtggctgatgacccagttctgctgggacagagccttgttcatggtggggacctctgactgccctgcccactcccctgtccccacacccaccgtcatggcccccatcctccgggaccacccatctgttctcccctcctcctaggccagcatcaggtcaatgccctggatgggggtcctcatgagggacctttacaaagggaattaggctgtccagtggggctgcatgggagccaaggaccagtctcactgggcaccccaggctcctactggccctgagaggcgggcacccctatgatccccccaaactacagaaaaggagacagaggcccctgtggggtggctggttggggctgaagcctggagccagagtgtgagtcaaataaacaccgagctcccgtctggcctgggcaggggggccagggtggggggcgggcgaggggctgtgccggagccacccactctgtttatgttcctgccctggcgtgtttaactcggcagtgatttatccctctatttataaatgaagggttaacggccctacccccaccctacagctgggctgaccctccaaataagggcatttctggctttttcaggagaaaggagaagtctttggggccagcagggtggggaggctcgtgggccgtttcttctgcacagcgcccctcccccacctgctggagaagggaggacacttaccccttcccctcctggtggcccctgctgtaaacaggctgtgccccgccactccctctgaccagtgcgtggccccatcccacccctggggaacaatgagccctgccttcaaacagcccctggcctggctcagggcagcaaaagaactcttgctttcagagggccaggtccctccagtcggcggccaccttcttcctcagagtcagagaggtcagtgcctgcatgaggtcacccagcatgccctctgcctctgggaccccagccctgggtgcgtgctaccctggaggctgctgggaggagtcaagtgctgcccaggcctgtgcccagcccctcctgccacccccaccacacaagggcccaggctcagctcccagctccccccgactgcaagcaagctctctatctccaggccctgacacgcgggcattgatgggtgcatttgttggatgaataggtctgtcctccctcagcccaggtgtgccaccagagacgggatttgggggcacagcaggcagccaggggaggagaggaggctgggcacatgggggctgggaacctggcgtctcagggctgtgggcttcaggagccccagaaggtccccccgaaagagatgcgtccctcccctgctgtggatgaaacgctctcagaaaaggtcgaggcggctttgcagctggactgagggactgcatggccaaaaaagtattttgggattcctttctatgtgccttttgcttttccaatttgtctgcacggggcctatattagtgtcccaatcagagacaaatcataaacaacacagaacgtttcctgtgggagtgagtcccagggtgatgctggcccctgggaattctgctgtcccagaaaactccccagggccagcccagcaggctcaccagcaacgctgcggtgctggggtcctggctagggatgtgggggctctgcggtctctggagctggggggatgggcagaatgtgctggacaccccagaggccagaccggagaggagagggagctagcaaagcatgctctgattccccgcactaagggtctgaccctgatctcaaacaaagctgaaccctcatcttggtcacacactgagccatgatcccagtaatgtgatgaacctcgatccctgtcccactctgagccctgaccctggtcacacactgaccccaatcctaatagcacaatgggcgttgattcctgtggcgctctgagccctgatcccagccacgacctgggccctcagcccggaccttctgtccctgtctctgccctcctctcccagcttcgtctggctgtctctgtctccatattgtcaacccccacctgcctcccacagcgacggatgtcccgattcgattattacggggcctctctggggctcccactcaccaccctctttgttcagaaggaggaggaatgcaagcggggactctagaccctgcaggggcccatggaagtggctccctggcgagtgcctggggaaaggagaaggttccgcccctcctgggacagcctggctctgcctgtgggagaggcacagactctgctctccggagggcccgggtgatgagcagtcaccagcacagagacccgggtttgagtccagccctgccactccctcagctgagacctgggcctggtcagtaggctggccgtcctcatctgctgaatggggtcactcgtgccttccacagctctgcctcgccctggtagcctggactgaggggagaggcatggttttaccctcagagccggccggagaggggaggcagggccctgtccccaagcctagtttccctaagccaaacctgggtgtgggggagatggtcctgtctcctccctctttcctggcaggcaccctgggtctgtctgagacagcagactccatggcgggggccaactggccagagtctcatgggcagggactggcaccgtgtcctgatcgtgctgacatggtgttggggctcagggcctggaggctgtgccagggctgggaggtttctcttttccactggcccaggccagctctgctccccacccacacacaggtacttccttggggacagaacagagggaacgagggcctgctctccagggctgagagtcagtgagtggagacccagcagggtagggacctggagtgtggccatggagccctggctctggcctggatggccctgccaaagcctggctccatctctgaacggactatgtggccttacagtctctgagcctcagtttcctcatctgtagagtgggcaaaatagaatctcccctgggggttcttgtcctgatgtgccagcccagagtaggggctcagacacaggaagtgatgaaagtatgggacaagctgccagcgggggacccagagggcgagggggcgagctctgctccaacctgggtgtgcagcctagaccaggtccagctcccacactactcactgcccccgccagcctggagggagggctctgacctgggtgggtcctctctgagcctcagtgtctcctcctgtgaagtgggaatggccggacacgctgccctgcatggctgtcttgggccttggctgaacagagcacctgctgcaggtgtggcggggcaggggcaggtgtgctgcggcatctctttcttttctgtttctggcccacccttccgggtgggcagacccccagagcccccacccctccaggtgggcacacctcccagagccccggcctttcaaggcttcgctgagctcctccaggggagggggcagagggtgaaggaggatgtccctcatgccctccccgtaggtatcacatcacaaaacagccgtcctaggcggggctgccgctgggttgggggttctccctgggaggggcctgaggcctggactgctgggcagggctggggatgtgcctctccagtcactgcacctgactgatgcttctgcaggcgaaactactagcggggcctaaacactccatgcgccctccaggcccaaccccaagctgttcctgctctctccctttcggcttattcatgcccatttttaggacttccccctggacttgcctccttaaggaagccttcttcctccctgggctgcctctctctggtgcatcctcccagggcaccctgcgcttcctcaatcccagggttcatcccacggcgctgctatgtgctgcaggcttccctgttggactctgagcatcttgaggcggggctgtgggtgggggctgagctcccatctgttccaccagcccagcacccagattggcctggcagagagcagcacccgtcttcccccttgtctgaatgaacgccctgagcaagcctcatcagggctggcaaggtgtggcctggtttctcaacctggcattcagggtgaatgccacctggcctggccccctctgaaacctgcctacccagtgtcttggtactggtctggaattggcttccacccccagccccatcgtcactacccatgagtcctcccagccgagcaaggctgacacctcctcccggaagcccgtcctaatcactctgaccattgtgtccacacttacattccttcccaccctctatctcccatcaccactctttctttctttcttttttttttttgagacggagtgctgtggcgaaatgtcggctcactgcaacctccacttcctgggttcaagtgagtctcatgcctcagcctctggagtagctgggattacaggtgcccgtgccacacctgggtaatttttgtatttttggtacagatggggtttcaccatgttggccaaggtagtctcaaactcctggcctcaagtggtttgcccaccttggcctcccaaactactgggattacaggcgtgagctactgcgcccggccccatcaccactcttgatagcaatggtctttggtttgcaggccagctctaccacccgccaccttcgaggcctcgggcaaatcatttcatcactgggagcctcagttccctcacctgggactttgggaaccatatttgttgaatgaatgaatgaaatcaggcagggtggctggactaagtgagaaatactgcagacacccccaacatgggaggcgtgcgatataagagcacgggaggctcctggttttggcacctggatggggccctgtgtggaccagcccgctcacacgtggggagaggccagggccaacacgtgtgctcagtgcaggacttctcagagcctttgtgaaactcacggtcctgggaacttccaaggggtgggagcgagcatcgagcatggaagctatttgaccctgtcccctccctgggggttcctgctccatccatcccaatggccacaccactagtccatgcccagagcactgatgggggctgctgcctccctgccctcacccacagcttgttgaatttctgctgggcacccggccatggaaggccagacccctgggcttggggtgctggcacctgcccagaggcctccagcggggcaccagggtcatgccggcctccgtccttggccggtgggtggggagggctatgtcctctcttccctgggctcctctcaaacccaccccaccaacctgggagttctctcttggctgcccagcagcctgtctgcctctgtcctgccacatgtgagaccaggcagcagagtggccccggccccagggcagcagatggcccagggtggctgttgagcctgcctgggggtctggctcaggaccctgtgtgctgtctgtggacgtgtggaggacgggcccagccttttccccacagaggggctctgagcacctgctaagggcgctttgcatccacacagcaatcccaggttttacagatgaggaaccggaggcccagaggggtgagtggtgtcctcacggttacccagcatggagctggtggggctgggaatcagacccaggtccactggcaggacccggcacaggccggagtggagcagagtgcgggctggggagcagaggggctggattaggcatctctggaccgggagtttgtgcacaaggggattctccgggccctgaggccgcatgtgtgaccacgggtctgtgtgtgcttgagcctgcaccccagacggcgtggccctcatggccttccagggctaaaatagccatgattcggggaactgtctgcctgtttatttttatgattattcttggtttcacagcatctgcttttgaatatcatctgctgtttttgataagtctgagcctccgtttcttccaccaagaggcaggtgggtgcttgctgagctctccaaatggggtcagactcaccccaggtcacctagcaagtcccaggtgaccctggccagaagccaagtctttctccctgtcccccacgcccacaggccagggctccctccaccccagtgcagagagagacgtcactggtgggcacagactgagctctgtggggaaggacacctgggccccatctgacccgactctgcctcagttccaccagctaagagccctcttgctgagactgcggctctaacggaaacaccagtgtctctgggaggggcatagccagttggaggtcctgcatgtcacctgccagcccctccctgcctccccatcattgggttcattgctcacctctagctgggtgtctctgggaggggcatggccagttggaggtcctgcgtgtcacccaccagcccctcctttcctccccatcaccgagttcattgctcacctctagctgggatagccgtagctgcagcagctcctgaaacccctccccaacctcagcctctccaggagctgctgggacaggcattctgtcatgtgcacctgcctggcctcagcctggtccttccgcctgaagctcctcagcctggtcctctcagcctcttccctctgcatgtgctgttccttctgcccggaatgctgtttctctccctgtgccacctggtgaaggctccgggcacccacagtcattgttccacagagctctccctgagcccctctgatgccctagtgccctggatgcccctgccccagggggagagctatgatcccacaatctgaagggcacccgctgggctcatccttcccagggtcttattgacttccctcaagatgcccctgggtgggtgtttctggccccactgtgcctgtggggaaccaatacagaggggctaagtcatgtgtccgggctcacccagctggggtgcaggaggggctgagctctgcctcaatctgcctgctggcactttgtcccagtgcctgggatcagccttctgcggcacccagccctgtgtgtggagggaatcagaggccccaggccacacagccccgtgcagtttggaggtgtcagaccaggacttagaccccagcactgcgggcacaaatgggtcccaggcagacctggccccacctttccgagctgacagctcagggtagggtgggaggtggctggtcacggccgggatgggcctcaggacaatcagagggaagagcgctcccggcagcaggaagggcacagtgagcatgaagggccagaggtgggaaggagagtctgtgttcagggctctgtgagacaccgggggcgtggggagggctttgggacgtatggtgaggggatcaacttaaggttctttgggccctgacgcccctcctcagggaggccctccagagcccacagccccgcacgcctgcaccgcctggcttccttcgcagtgccctgccacgcgcagttccctatgtccctgctttcctgttcgctgtgcttccctcactgaactggagtgcctcaggggccctggccttggctggcccctctgagtcactgagtcactgctgagtgatggagtggatgattttagaatacccctctgatctccttgagcctcagtttcctcatctataaagaggagatgctaataccacttaacaagaagacaatgaagccaccccgtgggctccaggagctgctcagaaatggtccaaactgcatggcccccacgcccggctctccagccgcagaccccgcctttgctgatgggcccacaccgtgtggctcagagaggggcagcgacttgccacggccactcagcagaccgccctggagcccagcgactggatgagtcctggggggagaggggagggaagacccaggatgaccagctgttgaaggaagaagacagggcaagtggacaggcccagcctcctgcggggtgcattccccgtcctgcgaggtcgccagctgctccacgtctgccccgccagcaccctggctgctggccagttcccagcccgctgccccctcgggaccctgtcctgccgccttctcacagcgcagtcccagtgcgagcttcgcggggctggagccagcttctaggtccacactgagggctggcaagcaagccttccctgggactcagtttccccacccctaaggggtagagacagcaccaaggctactgcagagggcctgagctgtgggatggcaggacgggcactctgaagagggagcatggcgcttggagcccatgcccacaaagccctcaccatggccctgccccagctgcggggtggtggtggctgaggccccagagcctgccaagtgcctctggggtcccccaactctgtccctggcttggcctgtgggccaccctgctgccttgccaggtggggaaaccaagacccagctctgggcacccagcagatgctcggtgagtgttgaacggagggatgaatgagtgaatgaatgaaatccagagttgggtgggcacctagcagcgcagctcccccttatgcagccagcccaactcacgcccatgttctccctcaggtctctgttttctcatctgagaaatggctccctgtccagcaggacctgctctgagctctccccagcccggatctggaggcagtttctctgccctgcccttcccactcctgcttggctgggggtgagaacccctgcagggagcagctcaggagcctcctatctagggaagctggggagagggaggctggggccagcccacaggggaacttaccgcgcttcacccgggcaggctggagatgggagtcctcagctctcagctctgcatgcagcccggac

SEQ ID NO: 2545 - DNA, 4074 bp, Homo sapiens
cgaggtttcatcatgcagatgaagcctccaggcagcagactgcagagagaatggatgggagatgtttattatcagactgaaagactgttctgccagtcattccaaaagggaggggggataacaaggtatgtccgtctcccgcttcccaccgtggcctgaactcgcttttcaggttcactttggaatgtccttagccaagacgagggtccgttcgtttggctgggggtcttaggattgattttctggtttccatatgcaatgggagtgggggagagatggggtgggggcagcctgaggctcagccctggccaaggaagccccctccaggcattggccaggttctgactcctacagtgttacagccggcagggaacttggacccacaagctcctcccctccccaagcctcagtttccttgtttgtaagatgatgcctggggtccttgcttccttgtagggctcaaacaagatcccaggctctattaggaacagtgccaaggcagggggcccccaacagctcaagcaggctggagtttggtgctcacggagtaggggaagctggtggcttctcaggctcatgacattgtccctgcagggtgcagggctattccctggtggggctgggggtgtgtgtggccattggcaggagccccgatgttctcatccatgagtcagcagagatgggaacatcaatttatttgagtggctggtgcagccgagtccttggaggacaaggagtttttgccaagcctgggccgaatgtgccagggcttggggcagggaaactgtgtccagggacacagcttcaagggcccctggttgatgtccccagggcctgctgagtgccaggccctgggactcagagaggacaccacccgatgcaggccctgggactcagagaggacaccaccggatggagctgcccaaagggagtgccagtcggatgtgggggtgggggaagaggagggaccaggatgtgacgggtccgaggtctcacggggtgcccaggtgggctggatttacagagcatgggcggcctgcaggaccatgaaggggcaatgggggcagaagacagaggttggaggcagggtggcatggagggtctcggggcaggggcaggagggtctccagggtggtcagtctgctgcagtcagcagagggcactggaggggcctgggctcaggctccaggtagagctgacctagcccagaatgggcaggtgagggaaggccaccgcctggtgggcttggctgtcccctcacctggaccccatcgccggcctcttccttgcacggggtagatgctcattgatgtggtgacgtctagcaggaggatggccctgggcagggctgtgagctgggagacctgggctgggatctcagctttgggcccacacactgggatggaggagtgtttactgctgtctctgaatggctgcaggaaggctgagggggcacatggttgatgggccaggccactctgggcacagttgctgagagtcggctcttcctaagtgggggcacccggggtggtggaagggagtcagatgccaattcccaatgggtcctggtggtcgtgccctgctgcagggccttggcacccgccgccatagccatggagtccaggggggcccccaggggctggaaaggcagggaaacagattctccttgggagcctccaaggaagccagccctggctagcacgtctgtgctctgtctctggctttgcctgttctggacatctctggaggtgtgagcaccatgtggcctttcgtgtctggcttctttcacttagcacggtggcttcaggtccctccgcattatcgcatgtgccagtgctttgctcctttttacacctgagtaatcgtccactgtggagtcatcctttcagctgctgagagatgcgtgggcagtttccacctgcagccatcgtgagtagtcgggtgaggctgctgaagcagacgagtgagggcactgcccgggccatttgggctggagcgggggtttgaactcctctttgtgggacggaggctgtgttcttgcccacacctctccctgctccaggcctgtcttccccttgggactgggactatgacttggtggcttcagcctccgcagggtgagcctgatcctgagagtcaggctgggctgaggaggacgggtgggcctcctgggggaggtgacgacttcggactggaccttgcaggagggatgggctgtctgaggatgggagatgggaggaggtattgcaggttgggcagcaggtgaggctgagctgggaagggaggtggttgaggctggttcttgggctgagtgctggggaggggtcggccggggatcaccgagaggtccctccaggctgcatgagcagaggagacaccctacgggtgatcttcttgcctttgtttctagaattcacaaatcctacaattctaagctctcagaacccttggatctgaaggttctcaaatgctaaggtttctagatgttagcagacgaaggtgtcaagacgcatgggatctacgatgcagagttctgagtggggatatgcgtcccccaccccgactcaccccacgacacatatcagtaacagcctctgcaactccgccttggtgcccccgcacgttccaggggcagccacactgatggattgctcagaacgggctggaggtgagatgtgtttgcccggagcccccacacactgtcgtctccagctgtgcctgtccctccccaccttccactctgtgtctcttccctgccccccttgtgccccagccccagccccccctgttctttcctgccacccaatcctgtgccccacgacaaggaggctgagcccagggatggccaggaaggaacccccggcaggctctcagggtgggagagaggttgtggggatcaggggctttgcagaagggacagggaggcagcccagagcaccccagcttcttggccagcagcaggtaacctggctggagggcggggcccccatgggccatccctgggccagctgcccagggctaccaggaaggcagcttgttttgtaggaggtcaggcagcgccctaaccccacctcttgtcttccctgatgtcacaccccagggtcagccccttgggccagaatgggggtgatggtgggaaccgggaagctgagagaacagggaggaggccgggtggggcacaccaggctgtggctgtggggatggggagattcctcgcctgggcaggccgggcagcagcggggcagtcctggggggtgtggtaaatgcttctgctctcttcccctgactacatgggagcctccgtcccacctcacctggaaaaggggcttggaactgggctgctcggccttgggcacaccaaacggggcccttggagccctgggcttcctggggtggctgggtccccaccctgcctctgatccatcctgagtctgcatttcttctccaggtgccccctgcccttggcctcccaccacggcctgggagtagatagtgggctggggcaggcccagcgctgtcctctgtgggaaaggaggactctgggcctggaaatagttgagtgtggacagaaataaccctgactggcctcaaaacagaacatggaaaattaaatagggaacattagcattcaccccgcgcttgccacagccactgtcccatttgggaggcgggcgcgcttatcctcatttagagacagggaaactgcggcccagagaggggaggtgaccttcctgaggttcctctgccagccggccaggccctgtgacccctgtgcctctgtgcttccactacacagccgcatctccacttctgccccgacagttcctgctgcagcagatgcccttccagatgcaaactcctacgcatccttcaaaacccagctaaatgtcacttcctccggaaagccttccccacctctctagcaggcagttgagcccagcttacatttccgacaggccctcactgcccgggattgcagctgcgggctccttgagggcagggattgtccctcattcatcctgattccatgccaaggcttatagtaggtgctcaataaatgcttgctgaatgata

SEQ ID NO: 2546 - DNA, 9615 bp, Homo sapiens
atgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgcaagaggggtccccagccccggctggccagacagggctcacagccttggaacaaagcccagtcgcctgttacaggatcctggaggagggagatgggggtgccccgggggttggggttgagggtgttgggggatcaacggggtcccctgggaggcctgcagggggctggcgtgtgataggagggactccacgctgtgtggatagaggcagggggtgaggcagggggatacatggaccaggctgtgcgtgctcagccgtggcctgggctggggccctcccgagccctttgctgtcccagatgttgctgggctctggatgaggcctcaggttagaccaggctggactaggggcttcagggcccagatctctgtgtgaggagggactgagcaagggtcagcgctgaccacaggagggagggaccactgtgccctggagaggcagcagagatacctgccgctggcaaccctggcagatgggacgagatgcgtttacagaagctttcttgggagtggagtctggagcgacctgcatggcctcctggaggagcctggcctctgcagaacgccctgctgtttgcaggcctggggccgtttgcagcgtctgcagttgtgtgcggggccgttgacagagcctctgactgtgccaggctgtgtgagaggctgcagctgtgtgcagggtcatttatggctgagtcctttcccctgtgacatgagataagccatcatggtcttgtcataatgaaacagatttgggcgtgagagggcattaagaactgtagagcagcaggaggcattgggcaccttgccatcagggagcctggaccctggacactgagccaggtgccctacagaagatggctgtccctctcgcagctgagacccctgagataacagcagcatctacagaaagattggcgagaacagcacggtgagtggccagggtgaggcctcagaatatgactgggatcagggttaagtctgtaaccaaggtcaggtctcagtgtgtgaccaaggttggggctcactgtttgaccaggatcagggctctgtgtgaccagggtcagggttcggtgtgtgtctgggatcagggctcaatgtgtgaccagggttgaggctcagtgtgtgtccaggatcagggctcagtatgtgaccaaggttgggactcagtgtgtgtccaggattagcgctcagtatgtgaccaaggttggggctcagtgtttgaccaggatcagggcttagtgtgtgaccagggccagggtttggtgtgtgtctgggatcagggctcagtatgtgaccagggtcgaagctcagtgtgtgtccaagatcagggttcagtgtgtgaccaggattgaggcttagtaggtgagcagggttagggagggctcatcctgtgaccagggttaacgcttagtgtctgaccaggatcagggctcagtgtgtgacccagatcaaggctcggtatgtgaccaggattagggctcaatgtgtgaccagggttgggggctcagcacgtgatcaggattagggctcagaggtgtgtgactatcaaggctcaggacgtgaccaggatcagggctcagtgtgtgaccaggatcaggaagggctcagcctgtgaccagggccagggctgagccgtgggctgggtggccattccctctgctgagggtgcagagggcctctgaggtaccccatggccacagagcccagcaccctgcctgctccctgcattctcagatagttgggtgctggcctctctgtgttccaggtccctgtcccgtgaccagcaagacccatcagctgattcctcacccctcccaaaatagctacgagagcaggtggggtgggaacagcccccgcacgtgacccctgtggagtggatcctccgcagtgggggtataactatcggcctggctgtgaactaccaccaccttttccctggtcgtgtggggcttccctgctggcgtacagggcccagcttcctcctggctgccatctgagcggtgcccaccctccctgctctgaggcgccccagctgatgcccgcccctcttagaccctaaaaactggacccatccctgcggctcagctggggtcgctgttcggatgcaggggctcacacgtgggctggggagtccagttcctgctgtggggacccagtagcttttctggaagaaatgtccttgctggtagatctggggtcctgagcaccccagaggagggagtggtgtgctgggcagctggggtcccagctgccagttaccgtgaatgtaggtggggacacctttgcctctgctgggtggcccaagggacctaggacaggctcttcgacagccagacactacctcgaccagtagtggagcctgaagtccactcttggtggacctcactgcatcagggtctgcctggctggagggtgacatgcccttccctgggggcttcaggggccatgaccctgccccaggggactgaggggacagggctccaccccgagaggtctgaggggacatgtccaagtcctgggtgactgtgggggacacagctgtgccctgggagccctggtgagtgggtcctgccccctgagccctgcagccccagcccagccctgcctcctccgtcctcccacccccaggacctgaagaagtacggggctaccactgtggtgcgtgtgtgtgaagtgacctatgacaaaacgccgctggagaaggatggcatcaccgttgtggtgaggcgcgcgccacggggaccctagtcactgctgccaccgggggagggtggggcggggggctccgggcctgcgcagagggtttggtgcccctcctgtggcagccctgggcatgtctgtgcctgggccacgtgtgtgtctgggtacatcaagggaaggccagggtgttgggccgtgtgacctcaagaaagtcacccttgcgcacccgtctttctgtctctagggtgggccagcacggttcgccaggcaggggtggcacatgcttggtgcatcggccaaggtggcgggtgggctcctctgcctgtctcaggccctcctctgggcctgtcttgggtgcatctcagtcttgctgcctgggcggctggggccctgttgccaggcagcaggctcctggggagggcccttgggcagtttcctcggcttctttggccctggggacccaggtctgggcggggggtggggcggttctgctgcgatatccttgggggggtgggccacagcagctgcaggcccagagccagccccaggggggtccacccccggcccggtggacgactgcccccctggtgcaggcctgcccagctgcgcctgggcctcagtctcctcagtgcggagcacccctcagtcactgcttttcatcccaggactctgcttttggctggggttgcagttttgtgacctcagcttggcggtttggaatggtggcagcgctggcggtttggggtcagacaggccttgggctgcgtcccgcctctgccctccccagccttgcgaccctgcaggtcactccgagccttgggttcctcacctcaaagcgaggctgcttggaagaatgggaggcaaaggcatgtccccgcttctcgcacggggtgcgcccacaccctccctccccttccacagcagcgggagggattggggtcagacgtaagtagccgtgacaccggttgtctctaggagttgccctgcctggaggctggggaggggtgagatgcccccgagggctgtgtgtctgcctcagtgggcccagcgggctctccctggtaccagacagccccatgcctggcacagtccctgcatgaacccgccttcccaagactgaaacgtgtccactcctactgcagcgccctggcccgggccctcccctaggaagactcacgttgcccaccgatctagggcgctgggggacgggacagtgggaagcacaggtcatcttccaagaccaaattaacccccaggagcaatgggccggggcccggtggaaccgcctgtttcgagtcctgccctcagaaatgtgggccctgtctcgccccacagccctgtcttcagtccttcctggcacctgggctgtgtgtggcatgtgccagccatctttgcatgccagcacaggggatgagaccctttgcaccagccgacccaaaacctctcaggctgccaccggcacacaggcgtgagggattgtgaccccagaaccagagctcgggctgacaggtgtggggattaggatttgtgcgactctggagcaggctctattcagaaaggggtggggtggtccaggaaggcttcctggaggaggggatagctgcagtgtacagggaatgatgaggagtctgaagcactcaccatggggtgcccataggcaagctgtgcccctcctgtgtgccctctgggtctgctgcccccaccctagtgggctcctggcaccctctgcctctcagagctccctttcctcgcctgagccccagagccgcctctctaccctccctcagccgggggtcctcatgtctgcttccctccgtaggactggccgtttgacgatggggcgcccccgcccggcaaggtagtggaagactggctgagcctggtgaaggccaagttctgtgaggcccccggcagctgcgtggctgtgcactgcgtggcgggcctgggccggtgagtgtcggggcggggtagggctcgccatgtcaggtggttgggcatctcgtggtctgacagcctcgcttttggatgtgggtcttgaacacacgtccacgcgaccttcccaggaggcccatgcccctagtgctggggctcccagactggtcctctcccagcatcacagagaggaagtgcttcccaaagtctaacccaacttcttcctgctatggttgaaaccatcctgacatcttgtgtaggaaagggctgccgtccccctctccagacacaaagatccccccacacacagctggggcctcagactccctgctgggagaacgggaggaagaatggcagctgggatcggatgacatgaccagtgggacacccccatctgcagagggagacccaggcgagcagagttgatagcaggcatggatccggctcttagcacttcacccgccagctcttatttaaccctcccccagcagatcacagagaggttgcctaggagggagccaggatttagacccagtgctcaggctgggctgtgaggctgtggcctccatgggggagcttcaggcaggggggattctgggccccttgggcccccgtgccctgcatcttcagcaggtgccctgccaaggggacaggggtgcgcaggctccgatgacccccgccctgctgtttgcccccagggctccagtccttgtggcgctggcccttattgagagcgggatgaagtacgaggacgccatccagttcatccgccagtgagtggccgcggtggtggggtgggctgtgagcgctgggggaggggagatccggctgcccacgaagggtggcggcattggctgtgtggttccgtcgctctgaggctgcgtcgatcagcacaagctgggccttgctgcagaaacggggaagcctgaggtgtttctgatgggtggggacagcagcccccgagtgaccatgcagccacacagggacacagcgaggccacccgccacgccgtcctgcccgccctccacagacagagctccttctgtcgcagccatcctgacgggggtggaaggacccccagagccagccagttcagtccctccatgaaaaactagaacctgaaaccccacaccacaccgtgtccacccccagggacgctgacagtgggctagtgtctcaggactactctgagtctagctgctcaccacccctccccccaaccccgagctctccagctcagcccctccccgccctccttagaggcttctaggccagctcgcctgccccatccctgtcacttggtggcctccctggggagggctgccatctgcccactgcccagggggtcctgggggagtctggccgggatggcagggccaactctggaggaacggatgcggcacctgaagcctgcccctgcccagcccaccatgtgtgtgcccgtgagtgtgacacacctgtggtactcctcggacaggcttggctggtggggccatctcttcctcccagaggcaggcttgttcccagccatgccagctggccctgtgggtctgtgtgagagtgtggcccgccctgtgggtctgcgagagcgtggcccgccctgtgggtctgtgcgagagcgtggcctgcaggtgctcaggtctccctggggaccatgggatgtgcacgctcacacacagacacgcatgggggtcatacaggcacacattcacaagcacatgtgtgcccacacagacccaggcatacgcaggcacacactcacaggcaggtgtgtgaacacaggcacatacagacaagcgggtatttgcacacatggacacacatggatgcactcaggcatgtacacacgtgtgcactcatacatgacatgcactctcacacatgcgggtgcacaccttccccgggttctctccccaccccacgtctcaccgagcaagggcttgtctctcccttgtggcttttgctgtgtggctccccgcacctgaggctgcgctggtcaggacaggttgggccatgctgcggaaacagccaggcctgaaccccaacgactcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagctttgctgggcagagactcctcgcgctactgctgctcccacttccttggccagggccagcctgtggccacgcctgaggtcatggcaggtggggatggatgagcctccagaggcgctgggtgggcagcccccgcccctcaacgcctgtcacctcagggcctctcaggtgtggctgcagcatcctctccaggaagtcttcctgttcaccccagccaggtacatgtggtcaaggaccaggtggcggggcagggtgagcacatagcccaggtccctgctgtaaggaccaggtggcgggagcagggtgagtgtacagcccaggtttctgctgtaaggacccggtggcggggacagggtaagcgcacagcccacgtccccgctgtaaggaccaggtggcggggacagggtgagcacacagtccagtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggacctggtggcggggacagggtgagcgcacagcccacgtccccgctgtaaggaccaggtggcggggacagggtgagcgcacagtctgggtccccgctgtaaggaccaggtggcggggacagggtgagcgcacagtccgggtccccgctgtaaggaccaggtggcggggacagggtgagcgtacagcccaggtttccgctgtaaggaccaggtggcggggacagggtgagcacacagtccgggtccccgctgtaaggaccaggtggcggggacagggtgagcgcatagcccaggtccccgctgtaaggaccaggtggtggggatggtggggacagggtgagcacacagtccgggtccccgctgtaaggacccggtggcggggacagggtgagcacacagtccaggtccccgctgtaaggacccggtggcggggacagggtaagcgcacagcccacgtccccgctgtaaggaccaggtggcggggacagggtgagcgcatagcccaggtccccgctgtaaggaccaggtggtggggatggtggggacagggtgagcatgcagcccaggtccctgttgtaagggaaggtcgcgcagctgggctggaattctgggctcagcccctcccttactcacaggccccccttcctggatggtggaggtgcccaggcaccacccttgttgtctgctcatggccttggggtgggtcctaccgagctagggaagcctgggggccgtagggagcccagagtcagcctggaggaggtggcgctttggtgagtttggaaggcaagcaggggtgagctgcagggggccaggaaagggtgactgtgactctgggagcagccgtgccaaggccctgggacaggaggggcttggccagcctcaaggccttactccagcccactgcactctcagattccagctccctggggcaggtgagatggccgagccaggtccttggatgatctctgttcctgttcccctcttcccaggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 2547 - DNA, 9615 bp, Homo sapiens; identical to SEQ ID NO: 2546

SEQ ID NO: 2548 - DNA, 235505 bp, Homo sapiens
atctgataaaatacacatttattagaactttttcagcagcattatttccagttgtttatctaatcaaagtaattacagtcagcactcaaaatatcagcaacaaatattttgagaactctggaataaaataatcagtagtatatgtttcattcattcatccatccatccatccatccattcattcattgtttaacaaatgtgcaatattagcacagagagtcaggtatgctatttgctatgggaaagtgtatattcctgccatggttcctgttgtgcagactatacccactatttaagaggagagctggaagccaggcacagtggctcacgcccgtaaccccaaccactcaggaggctgaggtgggaggatcacttgagcccaggacttcaagatcagccttggcaatatagcaagactccatctctaaaaaaaaaaaaaaaaaaaaaaccaataagaattaaagaaaagatctggactgtacagtacattctaatataaatgtacacatttagccacagggcctaataaaaagcttaataagaatggtttccctttctattcaggttcaacttaggaaataaatagtgattataatgatattttcatagaaacaaaaacccagttgaggctttacttaactggtattttttttttttgcaccttattttatgaagacacagatttggtttcagaaattcagctactgagctccaactactagggcaggtgaccaccttgaatgtcaggtgaggggagaaattgctccagggtccatcagcagaagagctcatttaattaaccacaaactcaatgcaggacactggcacttaatgatatgggatttcctcatagacatcacaaataaaaatgttgtcttggcagctagtgagagaacacacatgaaacagagagttctggttagacaatgccaacacacagaagggccaaactgaattgcttttcctaccttctgtattatctgaggagtctacagtcaagtccagatgtctatacaacacatagtggcccctatcaacatagccattaatcaaattgacatgtaatattgaacattaattaagtgctaatgtgtaaaaatggacccaagagcggggcctggattcctttcctagataattttataggaaatatgagtggtgcctcttctttagacacggctaaaggtccccagtcaattccttttcttgttggatcatttactataatgatcaccaaccaaatcagcagacatctttattagcaaattcagtaacaggataatctttccaaaatttacaaatatacaatatatttatagtattaccttcagacaacttcagtgcaaagatatacatatagtacattgtgataattatttgtaaaaatatgagacggcataagtaaaaaaagacacacaggatacctccaactataggcaaacagggaaaaatatatttttttcataaagtactgaatgttaacttttttcatctgtttgtaaaaaatatatgtgcaaaagtgtgtttctaattattccctaaatagctggtatagctatacttcagagtcttctttaacaagatttgcggtgtctttaaaagtgtcttctgttgcagaataggttggagttgggtctcttctcgaaggaggcttaggcttagcagggagcgaaggtgatggaggtggtgtcgcagcaacactttccttttgctcgttctccatctaagaatacaatgtaacaggaatcagccatttattcccccaaggtcaccatacacggtttttcataaagaagactatttgtggccactctgctcagaataatctaagtgtgtgtccaatttaaccaagcaaataatttctaagaaaaaatgtctgtgctaagaaaaattgttaaaaattacctgtgcatagattggattttcaaagttggtagtttgtttagattttcgtttgaagagattccattttgtcacctaaatgaaaaggggaaaacaaaaacctctcagtaatggaattattttgtgggtttcttttcctcctgtctcagttttaaaatttcttcttactgaagggtaaagcaatttgggacctgggaccatgtgattcagcccatatggtaaattgttcaattcctcctatggtccctgaacagtaactgaaactctgggctcttttaatcgaatggttttaaacacttctttgacttcaaatttatatattatagaatttgtgccatagtatctacaagcaaatcacctggttacctcagtacagagagaacacataaaacagacatgcacaagatgcatctggagaaaaagagatttctggggctgcctgaaaattgggtggagatggcaaagccaaactgtaactcttattccctaaagtaacattctttggtcaactcaagagtatcccttctcccttcatcattccctcctgtgtcacaataataataacaaaaacatctaacatttattgagtgcttactatgtgtcaggaactattctaagagttttacaagtttctgattttttttaacaaaccccagaggtaggtacacttattatcctatacttgctgagtcacagcaagattatacaactaacttgcaggtagaagggcaggtaatgattactcaggggacccagaggcccataaactggagaacccaaagataatcaccctggaccatggtgcgtggcccacgctttactgaaaagttgcctgtcatgctgactgccagataaaaacctggtgggagacaagggaacagacagcctactctcaacaggagctgagggagcccacaggttttatggggtgtctcttactctgtgacagcaggggaccagcctgtggaggagtggggaacacagggctacagaagtagaagaggtcttcactttaacccacattcaagtgagaacctgctttgtacatagtgcccccaaggggaacatgaagacattcaggtcagagccctgcctctgggcgcttacagttaagtggggcgggccaaagtctcttagatgtcattgcttcaaaatgaaatggctaacttgaagttaagcaattactaacaagaggaaagggacggtgactttcatttttgtctccttgggggatcctatgcatatcaatgtaacttttggaaaatgatagaactgaatctttttttttttttttttgagatgaagtctcactctgtcgcctaggctggagtgcagtgtcacagtctcggcccactacaacctctgcctcccgggttcaagcaatcctcccacctcagcctcctgaatagctgggactacaggcatatgccaccacactcagctaatttttgcatttttagtagagatggggtttcactatgttggccaggttggtcttgaactcctgatgtcatgatccacccacctcggcctcccaaagagctgggattacaggtgtgagccaccgtgcccagcccatgtttttaattgttagtctttcaacatatttatggatgaaagatacatttgtgggactctggcatattcaaatcaacctaggtgatctcacccaagcgcctctactgcttttaaagcatgctggctgttaactcagtgcccaggagggaagaaatacagtgagatccctggacataacatggaagacacattttagagggtctcagcctcactaatgtaaaaaagtaagaggaggaaccaaggtattacaaaagggaagagaaagaaaggactacaattggtgaagatctgctctcctttgaaagagactgtcagtttacattttgtttctgataacagacatgcagatcagaggttacagcctccccaccacagtccccttcctgcaccagctggggaaaatgtctatttagtgaagaagatcactagactagagatggactgagaaaaaatgttgaaaatataaaataaatctggcactagcttggggttgactcaggcttggaggaccaaatatatgacattcaagcatccgtgtgtctgtggaaaattaatcttcaaaatccatttttaatatagcttaaagaaaaaatgtttagtcccttgaaaaatctgaaactgaaaattcctttctagacaatatttatgtatgtctgtgagtgtatgagtgtgtgtgtgtgtgtgtgtgtgtgtgtgtgtgtgacatgagaagaagaaataagggaatttgagaaggtgtacagaagccttgatatagactcttctcagcatcaatttaggtcaaattttattttgatttaaatcagcagaacagaaaccaatgtttaaggtgataatgagactgccaagttaccaagatatcaatgtttatagactatgaaatttgagaaataaagattgtataaaatggtaaaatttccaactactcttagactttcatttctttacattacttcacaaaattggtcatagaatcttagaacagagacattccagatcctagcggttctcaaccaggagtgagtgcacatgtgttggggaggggaggtgatttctggggtcacactgaattaggggagacactactggaatttagtggacagggaccagaaatactgaaattccctgagtgcataggacagttttgtagcacaaagaactgtcccactcaatatgccaatagcgcccccagtgagaaatattattgaggactctagccccagaagtaaaacagtttgtccagattcaaacagctatatctggtatagctgcaaatgcattcattaaaactaatgatatacattaatacagagtttaatatcaaatatatttattgaatttcttcctgcagaccaaatagtgtaccaattgcaaaggacctgcaggcatgtttaagaagctccatctagtggcatttttttctttcaatctccagtattaaacaccatccctgacacatcgaggggaataacgttagttagatgattggttggccaataatgaatagatggatgatgaatggaaaaattagtgccatctagtggtaaagatctgtaatagcaggagagcgaagaacagcttgaaagaataaagatgcatgctgtagagaaatcacggcacacacagacggatctttcatctgtatctttgacaccgtgaaatctttattcatactgagtcaatttctcaacttaaatgtctctggtctgaagatactggatccagaagtctatttgttcttctttgtgacatgtcctcctatgttacaaggaacattattcccaactcgatgttagaatgtagctttatttggtggaaagtttttcaatctatgactttttaaaaaattatatttattaactgtcaacacatcttgagatctttgagccttccagaatctcccttgtttgcttaaggttaataaaaacccagtcatcccaaagtttttccaaatcccacattatttcaggagtcggcaactgttacctgagttccatcagcagctggtgaagttgggtttgtctctggaactatctcagaagggtttatgggacttccataattcttattatccacattttcagatacagtcacctgtggacatgttaaaggcctttacccaattttgaaagaatttagtagtaaataaatttgctgtaaagtttgtaccaactctggctctttttgccatcttgttctcccacagacatcatcaggcaccatttttattgcatgacccagtaggccaggactaaacatcactcccaccgccccaaaatcaagagcagcaaccactaagtcacctcataccttaatcctgggaggcaaatacatccctcactggtcacactctcacttattactagcaatttctactgtattctctataccttcttactcccactgttgaccaaatttttggataatcatactctagttatatactggaagccaaatcctagaagaacagcaagaataattccccaacctcactgatgaactgagaatcctatctttggatcttaataatttctttgaatattaataaatcctatcttcggaaattaagatttcatagtactactaaaaagaggttgaatttttgaaaagatgagaatgatagaattaataatcttctacgcatttttctataacattcatacaattccaaggttcccttttaagaccaaattaccatgaatgcataataaactacaaggtagacaattcactccttttcctatattttcacattcattacttgtttattctgaaacttggatatgcatttgtatacatggcctcattttattttaagtgaagatgtcaaatgaaatgtcgtatctcttttatcatgtgattaaagttttcatatctgtttatcagaggatcagggaaaatgctttcaagatttaaacatttccgatcttaaaatcacaaaatatttgtaaaataaacatttctagtttctgtattaaaatgtgccatatctcgagttcaaaaggagcattaggtgttaacaatgacagttattcattgtcactaaggccatagttgttgtgacaaaggagatacatgttcgcagttgacaagcagtaaaagtggcgctggggctattgatgcagaccttatgtaaagttattcccttcacctatattcctatttcatctcccagctcttcttaaagatgacggactgaatctcaaacatgctttctttactattcctttgcacccgtcatcccagcctctcttcactttcacttagactgaacctgacacccatcaggctcagcaaattacctgggctgtactgctgcaaagcttcacagacagcccccattacttcagtcaagcccaaatttcatcctcatctgttacctatttcggcataattctcataaaaacacacatgctctccctgctgatcaagtctgactaatctcccaaacctcaatcccttctacaaaacaacaactcctttccttcctaggcatggttagtgcagtcagaattcttacacaagagccgggaccgtgccctgtagcctttctgtccaaacaacttgaccttactgttttagcctagccctcatgtctgcgtgcagcggctgccactgctttaatacttttagaggccctaaaaatcacaaactatgctcaactcactctctacagttctcataacttccaaaatctattttctttctcccacctgacgcatatactgtctgttccccagctccttcagctgtactcactctttgttgagtctcccacaattaccattgtttctggcccagacttcaatccagcctcccacattactacggataccacacctgacccccatgactgtatctctctgatccacctgacattcaccccatttccccatatttccttttttcctgttcctcaccctgaacacacttggtttactgatagcagttccaccaggcctaatcgccactcaccagcaaaggcaggctatgctatagtatcttccacatctatcattgaggctaccgctctgccccgctccactacctctcagcaagccgaactcattgccttaagtcaaaccctcactcttgcaaagggactacatgtcagtatttatactgactctatatatgccttccatatcctgcaccaccatgcaagaggtttcctcactacacaagggtcctctatcattaatgcgtctttaataaaaacgcttctcaaagccgctttacttccagaggaagctggagtcattcactgcaagggccatcaaaaaggcatcagatcccatcgctcaggacaatgcttatgctgataaattagctaaaaaagcagctagcgttccaacttctgtccctcacagtcagtttttctccttcacattagtcactcccacctagtcccccgctgaaacttccacctatcaatctcttcccacacaaggcaaatggttcttagaccaaggaaaatatctccttccagcctcacaggcccattctattctgtcatcatttcataacctcttccatgtaggttacaagccactagccagtctcttagaacctctcatttcctttccattgtggaaatctatcctcaaggaaatcacttctcagtgttccatctgctattctactactcctcaggaatttctcaggccccctcccttccctacacctcaagctcggggtttttcccccgcccaggactggcaaattgactttactcacatgccccaagtcaggaaactaaaatacctcttggtctgggtagacactttcacaggataggaagaggcctttcccacagggtctgagaagtccactgcggtcatttcttcccttctgtcagacataattcctcggtttggccttcccacctctatacagtccgacagtggaccggcctttacttgtcaagtcacccaagcagtttctcaggctcttggtattcagtggaaccttcataccccttacggtcctcaatcttcaagaaaggtagaatggactaatggtcttttaaaaacacacctcaccaagctcagccaccaacttaaaaaggactggacaatacttttaccacttgcccttctcagaattcaggcctgtcctcagaatgctacagggtacagccatttaagctcctgtatagacgctcctttttattaagccccagtctcattccagacaccagaccaacttggactgcaccccaaaaaacttgtcatccctactatcttctgtctagtcatactcctattcaccgttctcaactactcataaatgccctgctcttgtttataccaccggtttacactgtttctccaagccgtcacagctgatatctcgtggtgctatccccaaaccgccactcttaactccctcttaaagtaaataaataatctttgctggcagggctatgccgaacctccttgggcactctctaattagatgtcctgggtcctcccaattcttagtcctttaatacctgtttttctccttctcttattccatttactttttcaattcatacaaaaccgtatccaggccatcaccaataattctacacgacaaatgtttcttctaacaaccccacaatatcaccccttaccacaaaatcttccttcagcttaatctctcccactctaggttcccacaccgcccctaatcccacttgagcagccctgagaaacactgcgcattatctctccatgccacccccccaaaaatttttttctttgccccaacacttcaatactattttatgttatttttcttattaatataagaaggcaggaatgtcaggcctctgagcccaagccaagccatcgcatcccctgtgacctgcatgtatacacccagatggcctgaagtaactgaagaatcacaaaagaagtgaaaatggcctgttcctgccttaactgatgacattccaccacaaaagaagtgaaaatggccggtccttgccttaactgatgacattaccttgtgaaattccttttcctggctcatctggctcaaaaactcccccccactgagcaccttgtgacccccactcttgcccaccagagaacaacccccctttgactgtaattttcctttacctacccaaatcttataaaacggccccacccctatctcccttcgctgactctcttttcggactcagcccgcctgcacccaggtgaaataaatagccttgttgctcacacacacaaaaaaagatgactgagcaacaaggctgcaacaaggaaatttagatatctgcccatcaactctagagacctttgtacttttcagaaaagtatggcaacagcaagcataagaggtccctctccctttaatccacctcaaaccacatgcttgggatagcagcaagaaccagagagtgggccccgtccccaaattcctgtatagtgacctgacaattctccactcattcatttcacaagtatttgtagagaagctgtggtgcttcaggcactgtgtttcccaggcccctgaagggactcagacctctcttgctctgacaccactcaaaatgaaaggttcttggccagcagccccggcatggctgccaaacctccaccactgtgcaacagaacaggattctgattgttttcaggtcttatgtccttgggttggtcctgttcctgcagatagggcagctgcagcatggaccactcactatgcttccttccctttggagggaaggttaggaaaatcctaagacatgactcaatagattaagatccagcgacagcagtaactgaaagaaaagactgtatggtttctcacctggattggctgaaccactttgacagcactgtctctggctgagtacattgggttttcaaatattatgggctgcttccccatttccatgacaaagtcttcactctgatggcagagacagaaagagagagagagagagagagagaaacagagagagagattacaccatactaatctggttcacacacaaagaaaggtgccttcctcacacctggaggtacgctaggtgctacgtcataagttacccaaaagagaacttgcaaaaaaaaaaaaaaaaaaaggccagcaaaacacaagacctccatatggcaaattattatgcaaagtaacataacatgcactaatttaccaactcaaggaaatggtaacattcttcttatatccaaattctcttaaataactcacttgggaattgggtctgggccacagagaaaaggataatggtggaagaagaaaagaagaataaggagagaggggaaggaaaaagaatggataatataatattctcagggaaggaaaacaatgaaagatttgagggagagacaaaattctgaaagtggtttcccaatactgattacagaaagccccctcagtgccaagactgtggcagccccctcataaagtatttcatttggtcctcccaggaggtattattttacctgttttacaaatagggacaatgagggtcagagatatcaagctccatgtctattgtcacatacttagtaggtggcagagccgtggtctggaccaacgccaactctaaaatcactgtttatttcatcactatacattggcagaaaaatatatgacactaggaaaaatatagttccctactccttttatacatataaaagtcatcaaataaaaacaaaatatcatgtcctcctcacacaccaccctcaaaaaaaccagaaagctcttcaatattcaagttaaacttcagactgttcatgattccaattcaacagcgtggcttagagcaggggtaaattccaatgttattaccaatgtttttagacacctttcagcaacaaacctaatgtttcctaacttgtgtagtgcagaccttattctgagaggcctaatactgtatttcagtcttctctaggtgaattttgttctttataaaaagtatttattctataaatgacaaccttcaaataatcattttgaaaccatactcaccattgccattgacctgtcaatagcagtctcaggtccaaaaccagacactccaatatccatgttaagatctgcccctgatctgaaggtcaccccattcccattttcagagggcttgacgagactgcttaagctggaaagaagtaaccaaaacagtgtcttgttatttaaaacaacaacaacaaaaacaacaaatacaacctttcacaatagtaccctctcctccacattgccaaatcttcctcaaatgtaatgctcaattcccactctaaatttacactgtcaaatatggtagtaagttcccttagctacctggaaacgttaaagcacattcctgaaccatgagatctaaaagaaaaagagtccagcacatagaaggataaagcctgggccatcacacagctgccttttcactcctctctgacctgaacacctaccagtaggcacaaccatttggactacaaaacacagcttgtcactcaggctttagagaagcacttgactaagaagttgggatttgaagtgactgctttacatcctcactactttttgtttctgtggaatcggtgaactgcgtattgtgcttttttaacttagaaagaaaactaagtccttcacatggcttcatatgaatttcttaggcttcaaacatcaacgttccccataatgaaactgaccttggcagcttgggcagagcaggcaaaagggagccggtccttctatagtggaagaatcctgcaattgccagagctccaattacgacgatcaagaggattgtcaacagcacagctactgcggctatagaagaagatagcagagagcacatcaacacatgggagcccgcaatcctggcagaaactgggggctagaaccactccttcaaagactgggttaagtagaaaagctgtgacagcattcaatgtaggggccatgagtaatttccaagttgctcacattcttaaaacttacttgttcctggagagatgccttttgaaaacgccatttcacaatattttccggtgtagccgctaggacacctgaaaggaaaaagcaaatcattcactagctgttatgttcttaggcttctactgcatttttctgagcacatcctgaagtagagagagctttgactgcataaattacatgttgaacagacaatgtatcctgcatgacttttgttcattctgccaagagaagacaagcagaaagaacagtgctctgattttagaaatgcacttgtaatggagtagctgtggcactgagggggtgagtctggccacgaaaacctattggtgtctaatctatgcaatgcttccttagagagtacaaatggaaaccatggttatgtttctttcttttatatgctttcattaaatgctttttaaagacatccatttatcttgctccatgttagagttttcgcaacacagtcatcttctttccgaatccatcccagtctttctgctcatcacgagtgccttgtactaaagcagccctgcagacagctcttctcccacagccctgttgtaatcaacaataccaggtgagtaggaaaatgctgctgccaattctctaactccttgctccccaaagtgtggtccaagaccctgtggcctacctagagcttgttagaaatgcagaatctctgtgcgtgagaatgggcacttgaaccagatctccacgggattcttatgcacattctagttaaagaagcactgcctcagttctctgtagactccctcaagggaaggcaagctggttaaaatgtaagaattagtgaactggtgaggttcctgtatttgttttcctggctactttaaggtctcaaatttccccagaagaggcaaggcctatagctgggacctcaacattcagacttacttgcatttggggaggtcagtctcatcaaaatagcaatttcctccgtgcatgcacctgcatggggggggcaggttgataggcagttcgatggctgcaggaagggaaagccatgcaggtgttagtcagctgtactcagcagagtgcccacaccatgcaaaccggcccaggttaggggtgggaggaggggcaggccagccaattagtctccctgtcaaagcttaccttccccctaagtccagtgagtttccttaaggtcttggagagtaacatacatttagtggaaagaaagggggcagtttatagaatttttcccaaaaaacaatggagaggtactagactctggagcacatatattaatagttacaagaacctagtggtaaaataatctcttaaaatattcacattctcatttgaagttttcagaattctcctccgtgaacccagttaaaatcaagagtttaatgtaggcccaccttgaaacttcaactaaagacaccaaagcatcagtaattgatcagtccacaggcagtcacatagctacagatatagagatatttgataggcagttagctagagagctcctgagttttcaagtcctcccaaactgcccttactccaagtccctgctcccagctaggcctgtacatactcccaggatgtgcctgatggggaattagtgcttcagtgtcttttatattgaagatgcttaataagtataggttacatgtgtatattatttaaagagtctagataccctcctggctcagtccttcaatctgagtctccactcaatgttcactgtatcagacaggtcttccctgaacactatctaaaggacaatccccactcaccccatcctcatccctcttcctctgccttcattttctccatagtaccacctgaactaccatgtatttattgacttctctatttattgtcctcttagaatgtaaactcaatacacacagggggttttgtctgttttgttcacctctgttacctccagcacttagaacagtgcctggcacatagctggcactcaagaaatctcactggactaattgcttaattattataccaaaccgaggccctatatggaatgactgccatcattcgtgtgcttacttcggttaaagttctttaaaacaagaatcttaataaaatccacttggcaaaaagtttaaatgagaaaagtagtagatgaggtgacaaccaggaccacactgctcccacgatgtgaaattgcagtaagtggcaaaacaatctatccacagcatggaacaaatctcaaagcctgaaattgtcattttgttccaaatatggctcgaaatattggattcctaccaatatttccccagtagcgttgggatgagtgcaagagtaggggaagaggggtgacaagaaacagttttttctccctggattcattccctaaacctgccaactcctcagcctgtttggaatgagtcaaagggtggttcctggtctaactgcctgctccccctggtggtagaaggtggttaagcgttttcctttccccatcagctaaaactgggggaaggccccaaggatgtgagccataaaatgggccgctagtgaattgcaggacgactttttcacaggcttttccagcaccggatgctagttagggacactagttattcgcccccatccggcttattaactccttaaaagagtcattgaaaaaaagtcttgccaagaatagatcacccacagcgtttgggactagaattaaaccacagcttcctcatgctggtcttcgtctcctgataatataaagcacttttcaaaaggtagccctttttcagttgtcaaaactggacatggttctctaccctgaggagctacaattaaggttgagtggattctggggcaatgggaatccagcttgaggtagaggtcttataaaaactcactcttcaaaatgtctttacaaaacaacacagcaatagatttagggacactggatctatatttctgcagatcttagcaaataattctcagcagtcactggaacacagttctgtttgccccctaagtcccactcaactctgttcatacctcccacatcccttaaccctccttccagccatccccactctgctgcaaaggacccagcatacagggattcttctgactcctgaaggcagcagaggagtgctcccaggcccccatagctgcttgggcagtgctcctacctgcatcacactcagtggtgctcccctctataaagctggagccttggggacaggcacagctgtatcctccaggtctcagaaggcagaggtggctgcagatctgtttgcaaaggttgggcactggaaagcgggtgagaacagcagttaggtcctgacagaatgaataacctgaatacccagcaactggaagtggctctgccaggtgacagcagagcctaggcatcctctcaatacctctcgtccacgtgtcagctggccactcaccctcatttacactatcatctctgccaccacactgcagtgggatagtccctctctgggccctccagccaatttctgtaccactcacattttctattggcatcacttatcttctctgctgccctgagaggtttggaaggtgggtatctggttcactgcctaacctcaaaatctactcagtgctaaacaacttgagatggttcaaaagaccagtgagatccacatattataccaagatttgtcactacccaaaactggacagatcataacatatggtctatccaaagtatactggatgtgatttccaccccaaccctccaaggagacatttcttctgggtttcagttaccttaattgcaagaaaagggaatttagagcaatggttcctcataatcacctgggagctattcaaaactattgatgccaggccaggcgcggtggctcacacctgtaatcccagcactttgggaggccgctttgggcggatcacgaggtcaggagatcgagaccatcctggctaacacagtgaaacctcgtctctactaaaaatacaaaaaaaaaattagctgggcgtggtggcgggcacctgtagtcccaggtactcaggaggctgaggcaggagaatggtgtgaacccaggaggcggagcttgcagtgagccgagattgcaccactgcactccagccagggcgacagagcaagattccgtctcaaaaacaaaaaacaaacaaacaaaaaaacctattgatgcccattcacagagattcagatttgaattggtctggggtagagttcaagtattaccattaaaagctccctaggtaagtctagagccttattaattctaccttagcatgtattatgatttatccaagggttgtactggagtggataatctttacattccttctcagactaacattctgtgatcctgattgtctgtcattcaagatgtaaccacagacaaagcatagctataaattagtaacacatcttccaaaagcctccatcaatatctgtctcattaccatttcgtcggccctccagagtggagattttcaaacttgaatgtgctatccatcacctggggaatcttgctaaaatgcagattctgattcagaaggtctggggtgggcctgagagactgcatttctagccagctcccataaggatcccaagactcctggcccatggcccacactctgagtagcaagggactggagcagcggttctcaaaatgtggtcactgaaccagcagcatcaacgtcacaggagaactagaaatgcaaattcttaggccacctcaggcatattgcatcagaagtgcaacagatggggcccacgaatctatatttaacaagctctccagataattctgaggcatgctcaactttcagaactcttggttcaaacaggctgggctggggctgtactccccatccccacccccacccccacccccactccaccagcactttccaaaggagccgccttccctgagcatcagctgccggagggagatgcttttccttcaggggcagcctccagactttcctctgccttctcctcagggtccagaggcggtagggaggggagatagcctttccaggtgtactgtgccttcctctcctacctttaaaattgccaagtgtgagagccgcaagggcacttaggacacaaaagctattctattggtagggtctggagtattctggagtgttttggtgatatacttccaaaacaaggaagccatgccctagaaaaggcatttgccacccctgtcatctcatgggagtctcagctttgagttgcaatttttcaaggctgatcaaggtctcaaaatatcagcagactcaagacaaccccagactccacccatgactcacatatggggacaggaagggagtaacttgtcaaaggccacatatccatagcattcaacctgggactttggcatactgaacactgggccaatacagcaagatgctgagttttgggttggatagaattgaacctaaaaattatttcatttctgagattaaaactcacccatttgttatgtgacttaggcacacaagttactaaatctgtctcggcctcagtttctttatttgagatgagaataaaatgtctttataaggtttgggaggtctttataaggtaattgaagtaatagatggctgaattaacactgaagagagaatttgacataagaacttagtaaaaggctatttcctttcctcacttccctttgcctttcatcttgctccacacactgctgaaggataaattagcgcacaggtaacctgaggaagcagggcccagaagtgggaaagtgagacagaggggagcgggtaggaatgcacatgactggccattttaaactaagacctacatatctcaggttgacctgactagcctagccttgcaatgggaaggataagatttctgatgcctatgaaacccattttgtgacttgttaacccaactcacatttagcaggggactgatgtctgctggattctgtggcctagaagtacatatccatcactccaaacaatgatgagggctaatatttttacttacctgctgatggtttgcataatttcatttgaccaccaattttatctttctttggtgaaaatggttaaaacgttcctctcccccagcaaacgtacatacacatatacccctttcatgcaccaagagattagcttgttgttatctactgccatcttccagcaatatagccattattttgaaataagatttccaagtaatgaggagcatcttataccaaagttggtgattacctgacttattgtatctgagttgatgaaagattcgaacttgagtgagccaagggttcactaccagcgttttctctttctttccttgcccaaatttattttgtttccatacttctcccttttccttagatatccagtataactggtcttcaaagatgtccaggctgtaagggttcattgctgcttacccacaggggaaaaacaaaacagaaggttattgaaaagaaaatacccactacaccctaccgccacttctagatctgatgtcattctgcttgaattattccctcatacaatgccttgaagctctgggaatattcaggctgactttagctacatgggactgtgaaagtgtgctgcattaggaggtcaagaagatagaaattaaaccacattgatgtataccacccgacaccaatcacagggccctagctcactttcaagttactgattttactgcatttttggaaaacaatttaaatggcaagattttatgttttcttttgaacataagacatctatctgaccaaataggaaaaatgtgatatgtgctgggtcattgcaattctgcagagtctgaacaacaacaacaaaaaatgttcatctcctagatatttacagttgtgcatactgggcaatctagtaaagtgaaaatgaatgtgtccagaagcggttagacatgaattaacattggtacacatgaaaccacctctactggggcaacctaacaggaaactcagttatttcaatatcttctgctgagaagcatttttttttaaagttgtgtaaaaaggacgaaaaggatttaattattgctaatgaactcatctgcatttaattcagcaggtgggagttggtgggggtggaggggtggtatctaaaaaactatataagccatttcctaagagcagggctccttcttgagaaaacaggcaaagacattagaaatatgttaattattaatttaatatattactttctaactaatttctaaccttcctttgcaatgactctcctatcagtcccatcatattttatggtttcaataacgtcctccttgaagtcactccagtagattcggtcattgttcaaataatcgatagaaaggccagttggccaaccaaggtcctcgaaaaccaggatgttgcggtcctctccattcatccaggcagactcgattttaggttcctttccccagtcagtccagaacataagcctataacagaagatttcttcactgtagcatctcacctggtaagacttctccactacagcagagcacagggcattacctacagggaaaccaactgtttatctcagggacctgggtgctcagtgacaccagttttatattttacagaagatggggagcaaaaataggggcgcaagagcacatatgatttatccttcttgaaaactgcacctccttaatagaaattggccgaaggatggatattcagaccctttaaaatgcattatgaaagctgtattatgaaagctgttcactcttcaagaaatattattgaaggcctactgtgtaagaggcactgttctgtgtttgggatctatcagagaacaaaacatacaaagatttctatcttcatggagctactctgttgcccaggctggaatgcagcgacataatcatagctcactacactcctgggctcaagcgatcctctcatctcagcctcctgagtagctaggactacaggcatgtgccaccatgcctggctagttttttgtgtttttagtagagacgtggtttgaccagtgctgcccaggctggtcttgaactcctggactcaagcaatccccccacttcagcctcccaaagtgttgggattacaggagtgagccaccacacccagcaactctttttaaatatgtcttttgcatccaattaataattaattgtagagcaagggtctatgtaagcaaagatgatctcacattgaattacctagaccagggattgcatgatttcaaatacctggagaggaacaggtatgtaagatgaatgaggagagatcccggttgtaaatatcaagtgatgcggagagcaagaccctgtgtaagagctcctgtcagtgcccaggaaggcagacctacccagtgtaatccgctcctctgatttccaaagcaagaaatacaggttttctttcttttcttaaattttaaatgtcagcactatgttaaaaaaaaaaaaatcttaaagctctgtgttgtcccagccaaatatgtcctatgggccatatttggcccaccagccgctgctttgcagcctgtagtctaaaccagtcatcaggcataggccaagttttaaattctactgacgaatgtgtggattttagacaaactgggctctggaaaaaatgcagccaggggcctttaaagtctcaacaactggtaaataccaccttgtttggttttcattaaaaaggacacacatgtgaaagaagctagtcacaaagaaccacatactgtaggattccatttgtaggaaatgtccagaataggcaaatctatagagacagagagcagattagcaggtactgagggcaggaaaatggtggctcagaggaacagggtttctttgtagggtgatgaaaatgctttaaaaccgattatgatgatggatacacaactctgcatataccaaaagccagtgaattgtacactttaaatgggtaagttgtatcataccatacataccatatgtgaattatataagctgttttcttaaagataataagccaggcatggtggtgtgcaagtagaaggctgaggcaggggactgcttgagcccaggagttcaaggctgcagtgagctatgatcatgccactgcactccagtctgggtgacagagcaagaccctgtctatataagtaaattaattaattcaatttaatttaaattaaaaagtattaaatactcaaaactaaaaaaaacaaaacgtagggaatggaatggaaaaaacacacaaaaggtacacagaatgatttttgtttcctccatgacttcgtttatgctattgcctgagcttctgaacagccggcctggctcctttgcctatcagtacccaagacatccatctaggttctatgtcagtcccactttctctgggaagtggcccttctcactctcacccacattgacctcacatgtcacatactttatcactggttatactaccagtggatcccaaccttcaacattcagttcagtgctactttctccatagagcttccctgaacccttgtaaggtaggagaactatcacagtgtttttcagcagtgtcctcatgacaattctccctttgtatcttatattatagtcaacagttgctgtctgaaggagcatggtgttattttacccatctatgtaaataagggatagaaacctatgactaatttatagatcctttgtacaattcaaatgagtttatatatgtaggacacttagcagagtagctggcacacagcaagaatagaataaatgttggcacttctcattgctgttgctggtattatcagtagttatcatcttcatcatcctttggacccactggcagatcttataccgcagaagctgtaagaaggttcaacacatcatatatgcttatgcttataaaacttatggatgatgagcctttcaaatggatcatgaaatgaggaggttgtaggtcgggtctgcaggccttaggcagtgaaaccctttctcactcctttcttacttcctatccctcacaggactacactgagccattccagagagaaaggaattacaaagactaaaataagaatttctggccaggtgtggtggctcacacctgtaatcccagcacactgggagggcgaggcagatggatcacctgaggtcaggagttcaagaccaggctgcccaacatggtgaaaccctgtctctactgaaaatacaaaaattagcccagtgtggtggtgggtgcctataatcccagctgccaggaggctgaggcaggagaatcacttgaatcttggagacagaggttgcagtgagccgagatcatgccactgcactccagcctgggcaacagagcaacactccatctccaaaaaaattaaaaaaaaaaaagaatttctatgaaaaaaacagtggagggatatcagagtatgataataatatcagatgaatttaaacattagttacagaggaaaaaattaaacggcacactggaaacagtcacatcattcacaccatagaacacactgcatctctttgctcctaatatattgtgtagataagatataagcagcaatgactaatgctgaggacaagtcctcactacaggttaatctcatcagtcaagtatttttcatatttcattgctgagtttctgagggtatgatttaacatatgaaatataacagaattaaagtaataacagctcatagggttctacctacaaatactggcatatctacagagggctagactggtcctgcccaagtaggaaaattatttggggtcattcaaaaaacttttttaaagtgtcactattctgaagctaagctaatatgtaaataccaagtcatttcagcttagtgattattcaaataaatgtcttgaaatgtagagaaaaataacaaaacttgttctcatttacactgagatgatttatagataaattgcaaattggaatatttatacaaatggataatatatatttatacatgtgtcattttaaatatttatatattttggatataaatgtttaatttttaaatgaaatatgaccaaatccctagctggatttcaatgaatgagttactttaaaacatccaaatgaaaggaaaaacaattctgttgaaaccttcacttaaaacagttatatccacaaagaactttagagttcagagctctgatttggcaaggaatccatgtaactagaaagattctcagatgtgttctaaaggaatttccccatcagaaatggttggttctatatgatctcaagggcatgttataattcttgaaacagtcatagacgctactcccaaaaacttgaaggacaatttcagttaaactaggaaaaaaaaattataagaaacatggaatttgatgagaatccagggagaaatatctagatgttgaagacttctccaagtacttaccctagtttgggattcacagcaatagcagctggttggtccaggtcagtggaaatcagccactttctgtaccttccatcaagtttagccacctcaatgcgtttattcttgacatctgaccagtaaatatgcctgaattcagagggacaaagttaaacaactgcaaagcctagagtaatcattactgggtaagaggtttgaagatgagagcatttcgtttggctggtgagacagctgctcagatacctatcatcagaccatagtccccctctcttgggggaactacagccaaggggacatgtttggcaggttacacttggaagagtaaggaattgaggggactcctgcccaacagccaaagcacctgaatcacgcaggatccacaatggaattaactcaattccaaagactaaacaggaaagtcaaatttccaatctgttttaactacaagcctgctaaatacacaagatgtggattgctcgtccccaagataactaccatagacacagcagtcagactggcctctgactggcattattatgagacatgggcttctaggtagaagtcataaggcacggtggggctggtgccttaactctgactgcccatgagtctgtttcctcctcaggaaagagccccgttagaatcaataggaacctggtgtcagctcaaagatgagtggaaacagccttttaaaataacaaactcggcaagactgtcctgccttatttccacttctgaggctgcaggtctcagtctcttacaagcagaaaaagttccaccactttcttaattctcttattcattaaggctgagaaagaggtaaaacttcaaacaagaagacagatctgccattccctggttggttttcagaagagagtgttaatgtctggagttttgagttcctgactctagcaacagtactctaaggccctgtttcttgactgaaaatgctaaaatgagtctcctgttagcctgcaggcacagcgggacccaattagcttcttcaaagatgctcttccaggaacaccagccacattttttaaaaggtgaaaaagaatttacactgaaaataactatccattctccaggagagtagtgtctcctgaaccttccccctcaaacatgtttgcattattggttcattttcaaggaatcattttcccaccaatgtaagtcagtgcaaacctcttccttgaagaatgagcttactaacttctccacatccatttgtacctcacacacctacctgatgataaccctacttaagttctacttaaaaaccatccaaaatgtgtggctctggtccctgggccactagaaggtctagaagaacagaagagactgacacctctattaactcaattccaaagacttctttagtcaaatttccaatctgttttaactagaagcctgctaaaaacacaagatgtggattgttcgtccccaagataactaccatagaaaaaaagtttcatctcaactgctttgctgggagaattgtgaggctgtcccatttcttcacaaaatgagcagtgctgccatactgaaagttaattttggaatccagaactctgttggcaagaatgctattcacttatagtaaatataatattcactattatatcctagatataatatctatatccagatattgacctgggtgctttcccaatttttttcatggcccacaaagaatacaggatatgataatgtctccatgacatgctggggtaagtggaggtagttgctggggcttcagcaagcccaaccactgcccagctgcacccatggctgagtgtactcatatccaggcccagactcactcatggcccatggagtgcagtagagaactctaaccaggaaaacagaacaggtaaggggggaatgtatggcaaatttaccttccaacccagtccactgctattccatctggctgcattacgtatttcagtttcaggtcaacttcctgcacaagattattgcggccggattcaaagttggggatgtaggcacgtttgatagcaccaaacctagagccctcccctcgcacagtgtaatacacaacacctacagaggaagacacacaggtcagtttcatgtcaagagcatcaagtaaaggaagaacaggggtctaatcaggtgaagtactgttcgtttattgacatctctacctccctcctcactgttgttataatatgaataattcaatgacatcagtataatcaaactttaaaacctatcaaacttgagctatgagctacaaatgcttcaactgagaacttagtgagatttagtcatctctatttaaaagtgattcatttaaacgtatttcaacaaagtgcttatttactcttattaggatcaagttctagtttccaaaacagaatgtatagagataaaccagggcaggctgttgagaatttgaaagcatactcaagatcagaggcaataaagaagccatgtcaacgagaagtcctattttatatacagacagaaggatggtggacagcaggcatgttaaaagcataggaagactgtgactgtagagggatgcactggacacctgctgctttcctaggtatgcaccattcttgaaaagtgtattgtattgcatgaatatgtgtgaaaatacaccaataataaatcctacattggtatagttattgatagttttcaaagcctttcatatctactatctcattcaatcttccaaacaactctcagaggtaagcagacagaacaagattactactttgattttgtagaaaaaaaattgagattcagagaatcgttacaattatttaggatcacaaagctagtagataagggagactggcataaaagataagtttacaggcacagaagacaagttttctgactcctaccctactgtcatctcccccaacaccagatagagccatgagagattcaacaataagcattattcatctttttccttcattcaactaaattttttgatcacctaccacatagagtgtactagatgttgggtcagctgctaggcatttagagataaattagattcagtctttgtccccaaaaagcagatgtctagaggatagaaagatattatgtggtcaactagctatataacttagagtaacatgtgccataaaatgacatagattcatggtgagcaatcatagaactctgccagaaggagtgatagaagttgtcacagaggtggtgacattaaactgggtctttgaggtctgagtagaaattttcaaggtgtacaatggtaggaaggaacaagatctgcagtatcaaggacaaggaaatttcaaaatacaagaagatgtgagatggtccagaaaggataaaccccagtgatcggaggagttttagaaagaaatcaggaaagcttggctgggattcaaggccacgctaaggcatcaggagcatgctggattggaagagtttcctcctccactaatgcaacaaaattcactcattaaacaataaattccttaaaagtcaacaccttaaaattctataaagtcacttaatatcaatgaaagatgccaaagtttatactcactgaggcctatgtccttgggatcccaatcataatcaacagcttggatatattcctcatcttgaagatactctgagaacctctcagatgagagattatattttcgaattcggacattgtcaggcagtagcaacaaaggagagctacctgtaaacaaacaaagggctactttatctgtttgaattatactttcctatataaagtaggatataaaatgcacagtatgtacctgtcccctttttaaagaacatgagtttttataggaatctgactatctctgttaatcaataaagctgactctccaactgggttacaaaatccgtgacttgacattctccacttcaagtggaaagctaatatgtctcttagggacattatcagttctttattctttgtactcagtggtagtatggaacaaagctagactgagaaccctacgtacagtcctcattttcactgaattgtttttatttactgacatcaaaacagactagactgcagacattctatctcacagaagaaatacttttatagtcttactaaaagtttaccagaaaagtctcattccttactgtttcctgacagattttatgattctttttagcaggtaatcagctctatgacccaatttagctcctagctaatgacaaaataaacctagcttgtccttgatttaatttttttaacctaaagcagctacttaatggtgactcatcccaagatgcactgtctagaatttgttaagtttaatttacttgcataatgtcaactgaatccaatttaagtaacttttaaaagttcattttatatatttcctctatcttgacattatgttttatatgaatattccaatttgtttcagtcatgtccttagttaaaggatttaaacatttaaaaaattgctgcttaattaccagaccaactgttcaaatgctttcactctagttttcattcactgtcaacagtgttttgagggtaaaatatgtaagtatgctagtcaaatgtatgctttaaaagctcaatttgtatgaagaaattgaacagccattttggccatttactcttaatttacaaaataaagtgctattttcttatcaagttccttaaactctagtacaaacttcaaattcaaaataaagacccatgcctcttaactaggatatgatgatttagatcaggcctctggaatttggagtataatacatctgacttacattctttctctgttttattaggcccgattgtcagacactggcatcaacctaaaacgtaaaactcatgattgaagttatgactgtgccagactcctttctgcctgtgatcagtagtccatgaacaatacaaaagggatatgtccttgatttgccccaattcacgagccctcttggactactgggcctcaaatcttattctcagtggagtgggagctagagggccttgttaccttccttttattgatgaccatcccataggcaagcttttgttattgtttgagccttaagaaagatgacatcttgtccactttttgaagtttttatcaaggtagacaagaggctaaatccattataataagtaacacctggctcttgttttaattgctacatatttgttgggggatgtagctattgttttaagctggcaggggaggagagagaaggagcgactaaagaggtgttggaagagaagcagctggcgagtttaaaaaaaaagaaagaaaagaaaaactatgagaagctgaagtttctttcatcgtatagtgtacttagcagtatttatttccccaaaagtcaattaatcccaacatgaacccatcataccctcagctgcacatcgttttccagggcggtcactcatagacgtgaagccatcagcacagacacactcataacttcctttggtatttctgcagtgctggggacaagtcccaaattgttcacattcattgatatctgtaggcaaaataaaaccaaatacgcaacatctgttcccatccattccttagagatcttgcttctgtttaaacccatattcaccagcaatgaggaccgagaagggtacagatgaaaataagcaatgatacaaacatttgtgaaacactaagtttcagatactgtttcacatgcttttcaaatattttcctcgtttagtcttgccaaaagactttaagaggtatggacgattaagcccacagtcccaaagctgataagcaatggagacaggatttaaactctatgactctgcaatagcagagcacattttccctttcagaaggcatatgttgtgttgtattgttcggtgtctcttcacttctgctaaccagcttcaggaacaggagtcattgatttagtttttcaattgagttcttaagcttcaagtccaaaaggaactcttacaatcttctgactatgacatatcatgaattagaaacagtaaattcaaatactaaaaggcacctaaaatcatgctcatcactcaccatcttgataagctaccttctgactccataccttacaactcatctatgtctggcgtaagtaggtgtataataaatacgtgttggttgtttgacttacaatgaagaaagtaagcctagtttgttttttaaattaactttgatttcacacactggtgcaataagcagccatcatcaccaaggccttcatcattcatatcaattccacagactctactgagcacacagtatctgacaagcactcaggtaggcactggtcagatagcatgcatgcaggtgggggaaagcaattcttgagtagtttaatgacctagaaccatgaaaccatgagtatggtaccattaagggaattaaatagtgatttatttaacaaaggggagtgggtggagaaccttagatgtaaagttcacctaaacaggaattggaaaaaatatactctacctagacaggaggttctgtcaaaaacattggtttcgaacccagctgtacaggagcagataaatcctccttcatttaattgggtacaattttgctcgcatatattttcagcacatgttctttcttttcctttatctgaaaaacaaaatcccagcattacaaaccagatcagccacaaataacagtcaagtggtgtatcaaaagaagcacctactcgtaaccaactataggacatcttgagataacccctttccataagccttggagaggacagagggcactgggggagtcaggattcctatttctgatcgtgatctgaataccatttagataaatgcatataatgctaaaactttgaggcaattttcacattatatgcagcactcctaggcttatcctcagagcatccaattctggactgcacaactatgaagcctgacactctacagctattaccacctgctctactatctttaatcctattgcaaatagatagatcaatagatagatagagagatagatgatagatcgatagatagataacagatagaaataaataaataaataaataaataaataaataaataaataaaagacatggatacagataggttagaacaaagttacaaataggaggaaattataaaattttaagaagactataatttccctaacattgaccaattgattatatacacacacacacacacacacacacacacacacacacaaatatatacatgtatatcaagtgttgaccagggtgcagtaaaatacatagagttctaaatcatacaactgctcttagagccataaattagtacacaaggaaagaaattttgtactatgtatgtatgcaccaaggactttaaaaatattcatactcttttacccagttattccatgttaatgaattttcccttgagaaggaatatgcagtataatttacgtttaaggattataaaaatatttacaataagaacatttgtttgtaaacaacttgaatgtatgttcagtgatagggaataaattatgttatagtataaaaaaactaagacattaatgatgcaccattactttatgtaacactaaaattgaatatgtctggaacttacgctgacatgttattaattgtaagatatatatcttggtttcaaagatgttaaaatataaaaaaatacatcttagaagcaataagttatgattatctacatgatgaattgctatgtgattattaaaatttatagtttcaaatgatactttgacatgggaaatacctataataaattgaaaaaaagactgaaaaactccatttagtatagaatatttcttaatttttcaaaatactaagaaatatttcttacatatacatatgcaaaaaaaagatagcaaaagtacaccaaactttaaaggttagttctcttttagtgatgggattcaaatgatttttacttttgattgttattgaactttcacagtaaaaaaaaaacaaaaaaaacacagtttatttttgtagagcccatataaatgatccctgttattctgatccagatgttccaagacagacttttaacagctcacactttaccctaacacttcattgttcatcattgccccaagatcttgtctctaccaatatctatccaagccatctggctttcatccttgtcattcttatcagtttgcttcttttatcctccatctatccccaaacctaggtcttacagaaaaactggcgaagatgaacatagatagtgagtgataatgggggaaagagaggcagtggttatctccattaaggatttaagcttcatctacctctcaaataaaaagtctcctggtcataggcttctgagtattttagccaaagagactgtggtatctcctgatttaattctttcaaatcaaaatagatttatatctatctgttttccatagtatgcaatgaggtgaacttaatcactctcagagtcctttagggtaaatgatcatatcactatatgtggtctgagtacattaagaacactgggtttcaaaaagaaaaataaccaaaataaagtacaatgaaattcaatggaatgctgcccttggagtgcagacttcaaagctgtatgcatgaaagtcttataataaagatcctagcctttattataggagctcttaacaactgtacattgttaaaacatctatttagattttctatttttttcatgagccattttcagagttttgtgtctttctaagaatttattcacttcacgtaagttgtttgatttattgccataaaatttgtcatagtatttccttactgtcctttgaatttctgtgagattagcagtgatatcccctctacattgctaaatgaatctgacctatgtttattaacttggatatcattgagccagtcacataacctccatgggtctcacatgcatcactagactttgtaatttcctcctagctctgaaatctataaagggattaggggtcccaggagtcaagaatttctggaccaagtgatccactaaatgagtcacccttttgtgaagcaagagtccttaacaagagcagaaaccacacgacactgtaggattcttcctaaaatgtgagggctttcttatcattgttttcatttgaaaatgatcaccattttaacccgtataactgatttccccaaacccaaacatatggcactctatttataaaagaaataccctactttccattttatgaagaaggaataagaactaccagagaaacagcaagtcaatctatctttatgatcacataaataatatttgcaacctgaggttaatttctttcctttatacctgaatggtgctagaaaaaatgctaatgtattttcattcccaaaaatttgccaagacagtagactttaggtgctcttaccacaaaaataatttttttaaagataactatgtgagataacggatatgttaatttgcttgattataacacatcactatatataagtacatcaaaatgtcatgttgtataccttcaattttaaaaaatcgaacaatgtgtcttaaacacttcagtgatgcttttggagaagaagaagatgaaggaggaggaggagaaggaagaagaagaaggagaagaggaggaaggagaaaaaagacaaaggcaaataaattaacagcacccaagaactagtatattaaaaaagaattctatgcctcaaattattagtccagagaaataagactgaattccatgtcacatattcacttaatatctgaaaagagaagctgcttccatacccgaattgtttgtgctacttatttccttaaaaaaaaaaaaacctgctactaattaaatgccatttgaaaagaaagtactgtagtctattttaagccacctatcagtctctgggagtcagaacccaaacctgccattcagttttgcaaattctatcatgttcaggcttttaaaatattttatcaagtcacttcattctgtcaataactccaagtcccacagaaaacgtatgtgaaataaatggcaagccaactcaatatggctggttattcatacctcttcgtaactcacgcaggagaaaaattgatagaaaatcctttggatgcctcaggaaaaagtcaattagagcccaagaagttgaaagcacatggagctcactaggatgactaagtcacaggctcctagagtttggagaagggcctcctttttcctgtgaggaaaccaaagactggagaggtcagtatgtgcccaaagtggcacagctagtggcagggatccagaggccagccctcctaacctggacttacatgactgctccaattctgcctctgacattctgtgtgaccacaaggaagttacttaagctctctgagctttattacatagacaataacagcaactcaatggggctaacttgagtaacacattaaataatgtatgtgaaagcactttatgagtcataaatggactacaaaggtgtgacttagtaacatgtcattttaacatttccatcaaaatattgagctagaattgttccttggttatgttcatcatccttttcctacacaaagtgctccctctactttcttttttgtttgattgtttgtttgtttgtttgttttgagacaaggtcttgctttattgcccaggctggagtacagtggcacaatcacagctcactgcagcccctacctgcactcaagccatccttccacctcatcctcttgagtatctgggactagaggtgcacaccactacacccagcaaatttttgtgtattttgttaagacggagtttcgccatgctgcccaggctgttcctgaactcctgggctcaagagatttgtctgcctcggcctcccaaagtgttgggattacaggcatgagccactgcatccagccactccctcaactttaaaaataaaaataaatgtcccttcccaggtcccctgtggcgttcccttcttgatcaaacaccctcagaaggattttcaggtaccaaggatactgcatttggcttaagatttttttcatgtatatactttaagttccagggtacatgtgcacaacgtgcaggtttgttacatatgtatgcatgtgccatgttggcttgctgcacccattaactcatcatttacattaggtatttctcctaatgctatccctcccccatcctcccaccataatgtgcagactaataaacaaaatatgtagccttaaagtgctaagaggcacccagtggactgggaagaggacttgctctgcagtgaaacagaccagagttcaaatcctgagtcaacctcttaatgacagtaagacctggccaattcgtttaacctctaagttcgttgctcatttgtacataagaaagagataataacatctaactcataagattgctaccaggcatgtagaatgtttgacacaatgtctggtctaggataagcactcagtcacagctagctatgggcttgactggaattcaagcaaaaagtacattaaggagaaaatgtggtcagtgtctacattatgttattgcatgttttaattaggtaaacctgagttactacaatgaactataaaaacaagtgtttacttactgcaacccagttcatcggaccagtcaccacagtcatcggcatcatcacacacattgtcatgtggaatgcaatgcccattgccacacttatattcatattctgtacaaggtttaggggtcggttttctacctgcaatgtaaaaacaagttaaaatcaaaactttttcttttatgaagcaagatacttccttctttgacagagacagtttgtgcttaccaaataaacaagtgcttccctacatttcccagtctcccttgcagctgggttaggaccatgtgaccagttctagccaacgtactgtcagttggaggtgccatgtgtcactactgggctgaagcaatgaaaagcacacgtgcctcctccgtgtctcctgtgctgctgcagcaaccttggaagccatgtgttccaggcagcacagctgcaagatgcaggagggctgtgaaaccagcgttggcctttatgagtgctcaataaggcttcattatgttacacccctgagatttcaggatatgctggttgcaacagctagtattaattactccgaataacatagagtgatgagggaagtagagtactgccataataaaaacataaaatatttggcattggattaacagtcaggaggcaagcaacaaggacactgatagtggaggcaggaaaggtggagatcatgttatgcaaagtcaaagcatttgataaagctatcacctcggaaaaactggaaggcagatcacatgcttactgaacctgtcaatcatggagcgaggttagaagatagaatgttagtaatgtgcattgattgccattcctgagtttggcaagatagtataagaaagagagaacctaagggaagaactggttaccttacaagcagaaataaaataaagcccagaaatttgctgtgtgagaaaagccacctgtatctacatcccaaacagtaaaagtctgaagtttaaaaggctgtgagacacgaaggcccaataaaacctcctcattggataaaatgactgcccatctatttttctacatggattggatgtaagtgacaataagttcagacagaactctatgaaggaaagaaagcaaagaaaaaagcagatttgagaactatgtctccaaaagagcactaggtcaggttactaacttttagaacaggctagaagcaaacagatcaaatgcctggtatgtttctgagagaaagatataaccaaataaaccaaaatactatgactgtttgagacttggaaaaaaaaacaaaaaacaactcctgggctcccgaccttctataagcaagaagtggggtgagaaagctgccgtgctggccctaatggtagcatatttccctttccctcttcatttgcagaggaaaatagacaagaaaaaactctcaaagggtagagtcagaaacagtgagagacattttaacacaggagctcctcccagagcagaggcatgagctaatcaataaataccctccactccccaaagaagggacctttacaatgtctgcccagagtggccatgtaatttactctcctttccaagccagtgtgcttttgaaagtgaaggtggtgctattcataattccactggggcagcagacatgaatcaggactgtcctgtgctaacatgtgtcatcccagcccagtgggacttcagaattgctatacattggtgatggccatgagtctccaattctttctttccaatgggagtgtttatttctattgtgttgcccctgttccgccaatacctatcaggcacagaaggcactgattgtttattagtttatgggtctcccaaccaagaggaaccacatctggaactgattgagtggctactgcccattacccagaggtcctggatttcagtttcggaatggactatgagctatgtcccttgggaaggggttaagggtgttctgtgtgtgagaagaaaatcataaaggagtatttagtgacacaagggtaaattgtatgagaatgcatattcttgcattttccagtctcccttacagttagagcagggccacgtgactggttctgaccaatggactatgagcaagaggatgtctgtcatttccaggctcaggaagttaagaagctgtgtgcctccaccatgttgatcttctcctgccttggcaaccttgaatgtgtccctgatggcataattatgggatggaggagggttgcttgactgtcattaaactttacatgagcaagaaatgaacctttgccattttaagccattgaaatgttgcaggttgcttcctgtggtgactggtagtggtctcccagactaaaaccctgttccttgaaaagaatagaagtttatggattcttttttccactctgggatttgaccatgtgctacaaatgtcttgctccattttttaaaaaatggcatttttagcaggggaaatggaaagagattttggggaagggggaaatctgctcaaattctttaaaaatattttatttctgggctttcatgcttttgcgctatgcctcaaataaacatattaatgctataatgtattaatgctatctctgccagtaataatgataacaggaatacgaacttgaaggttgtggtagtgtcaaagtcctccctgacagtctcctctgggatgggggctggaagtaagcattctgtggcaaagcgttctaagaccacatcaatacaagaaatagaaagtggagaaatcaggcatttatcttaattttcccagataatgtctttttggggaaaaaaataattggagtcggggaaatgattttcctcactgacattttctaggcaaattaaattgcccagaaaattggtcaactttccccttcaatggatagattttaaaacattttgaaagtgcagaaaaagtacagctatttcaatgcctcgattgttaaatgcagccagtttggaacttctatcttaaactaatctatcacttttctcttctgggaaatgaactttcattttcaacaaggatattagataagctctgttaacaccagtgctgccttgcttcacatgatctctgcagctgggcacctgcctagattagcaattagcaactcctgaaggctgaaggatgatcaaatctcatatttgaaaaaataaactattaatttgcgaggtgtggctcaatcagtatttagtgtttgttctcagtttcttatgagaaaagaggaggggaaggcttattaaatgttcaaacaaagactgaaaaattaatggatttgccagcatcatgctcaaatgagacaggaagaaacaggcagggttacatgtaagcaatgcatgtgtttgcatggtcttgtaaacaattatgtcagcagagatctgcagtcatgggcacaactctatagaacaaactgaaatcccagaggcacattttccaaactgcagaccacttggggtccttcctttttccttctcccttttgacttttgcttacagtgctcctctgtctcatcagttccatctccacagtcatccacaccattgcacacctcatgactataaatgcagcgattgttgtcacaccggaaacggtttggtgaattacagggaacatccactgaaaggaaagatagaaaaatgaaattacaagttaacagtagaatctaagtgtcaatatctaaaatactccagtgtcagcaccaggcttgcttcattcatgcactcatttactcatttgattaatcaatcagcagatacaccttacatgtatagtacacaccaaggcactgtgctaggcagtagatatgatgggaaacaagaaagacacagtccttgtcctcatggaactttcattctagtagagaaacaggcttttcaaattaaccattcaattacaactatgaaacatctactggggtgatctgacttaagttagggagaggaaggcttggaagaaacttcccatagattctgagtcagagaggaggatggcaggtctctggacctgaataaaggcctcggtggctggagcatggatcgtggagcacaatggtggctgtgaggctggacagactggcagtacatggactcttatcctaacagccaggaagccatttgtttgatcctcctgatggcagttgtcatagagtctctaccgcatgagtcttttattgaagctttaaattgtgttggattttccttcctgaattccctcacctcttacatttaaaatcgatatctcacaatcaaaccctgacacacttgctgtccagagtgagacctctagctgctgcctgtacagatgtgaggaactcaagggtagtccccaggtcccctacttgtttggtacagggaacatggttcactatgcgtgtaccacaaatgcagtgaactcaacatacatgtggtcttcacatgtggtctgtctttcacatggaggatttgggctgtctgattttccttccgccttggtatcacacacagggatcaagaggagagacttataataagattggttgaggggaaagggtcagatctaagggctgattcttggaagtattgttaatagaactattgcaataattatttgctgtgaaaggcaagttcaatattataaaacagtattggaaaccttttaatgtagctgtgtctctgactctccaaagtttatttttactagctatgggcattttaccttatggagagaagagatttcctaaggacttctttgaaagttaaacatgtctaagatgtgtctcaagattcatgaagttcaaagcaaaacaaggctagttcctaacaagtaaagaaaaatgttgggatgcaactgtgaaatataatgaacactaattaaagttttctgaggagaaacaaaatactaagatatatcatcttcacaagtcaaatctctgggctaaaaatgagtagtgatgaagctgggaaaggggatggaagatgcaacgtgaacttccaacaggagtgcttctccaggtcttgtctcctaggttaagggcttttacttacacaaaatcctgacactttagtttgcatcagaatcatttgaggggcctgttaatgtatagattgctgggcccttaattttcccacaaaattaaggccactttggggaaagagctcaaaaagcagggtctttgagttaatgcctttccttcctctacttcttttggtcttgatttttaatttctatttggatagggtgcatcccatgaatttgcatttctaacatattcccaagtggcactgacattcctagtccaggtaagacacttttgagaactattaccctagagttcctccaatgactcaaagcatgtagcaaaatgactgcaacaaactctatttacgttcacttcattaaaatcagtagttctcaaccaggggactaaactaaaaggctaagaagccttttaaaaatacgtatgtgcaggcttcattcttggagattctgctccatcaggtctaagcctagggtgaggccagggcatgtgattttgaaatacccctcctcctctgctactgacatgtacctgaattgagactcacaaacaagcagggtttaaaatatatatatatatatatatatatatatgcatcattcagcaagagggaattagatggccttgaattaccatgttaaaaggaagtgactgtaaagattaagaaagtcttagcattttctaaaggtgctccaggaagctctaggggtttggagagggtacttcaggggcacccaaagtaggatacagcaggagaggtacagcctcctccctacccttcctcagacttcaaccacaacagacctgcctttatttatgcatactaggttttcaagcaacatttcccttaaagacattgttttctaaggccataatacatttaaaaacatggaggttttcccaactttctcaggttacagagagaactgaagctggaagacccagtgaaataacaccaacgctgatcctgtgtccattcctaaacaattgtacaactgctctccaggctcacatgctacacgtaagaaacaatgagatttgacagacaacaccactcccattcactccgtttctctccctcttacagcacaggtgaagttcttcatctgaaccatcgccacagtcatcatcgccatcacatttccaatatggcgggatacaaacatggtttttgcattcgaacatagtagcctggcagtatgcaccatcaggaaagcgtgtggctgccatgggggaaaaaaacatattcaaattattatacaaattgactactttggggaagcttcctgctatttctcctttggctcttgccattatagcctgctcttctttattcatcaagatgtatagtggccttgacctgtctgaaagttgaacggactatgtcttaagggcagttgtcagagcccagtcagtttccaatggcatgaatcatccatggcatggacagcactggacttaatctctacaggcaaatgtcaagactggttttacccacatacatttataaagtctctttggcaaccacatcatcaacgataaccatcatggatggttatcatggatgatggttattgttgatggatcagcaataatgatgtataaacagtttgcattgattcaagtgatccataaagactcaaatctgagtaatcatgttggctttccagtttttgtagggaaaagaaagatcagacagttactgtgtctatgtagaaaaggaagacataagaaactccattttgatctctctcagtcttctcagtctctcatcccacctgaggagaaatacctacaggtgtggaggggctggcccccttcaagttttaatcatttttatactccatcgtgtgactgagaaaaattttaatgctataaattcaatatgttcgaatacccaacccaagttctttatactaatgtattcgttgcttgaatatttttttacctgaaatgttttttatctaattaatgatttgtatagtagctgataatatataaatactttgttagcacagattacttaatatattctccatttaaaatagcaaggaagtacacttgaacggccattgtgaaatgtatgattatgatgacttagaactcaggtgaactgatcattatcagtgcatgctgaacagacaatacttatggccttttaatctaagaagcggcagcggactgatgtctaaactatcatatccatgctctcaggtaagcagtactacatatgtgtctagggacttacgacaatcagcttcatcagacgcatccaaacagtcagcggatccatcgcatttcagttcactgtgtacacaatgtccacttgtacactgaaaatattcaggatggcaggtcctcatctctgaagagaaaagattgtcattccgagaaggccttgtcattttcagacagatattaggtacctggagtatagtggttactccatcacattcctatctacaccctgtgactggctcacagcaaacccacaacttgtggttagcaaattaatacattctcaaaactcacactttccccactcaacatacagagatggaagtacctagctccctaatattaaataatctccagctcttaagcttttcctcagaaatcggaattccccaatcttcaatgttttctaattttcctaagacccaacaccaaatcagtaaagagctataaaaattactttgggtttaggattactctgtcaatgatctgatctctacacaagagagtcataggagcacatgcatattccttagggtgactttccgtggaatagtagcaagatcaatgtctttgtttacaaggctaacgcagattaaaatctgctcctaagaagtgttgatattaaaattaaatgtttaaaattccttgctattttcctcaattatgactaatctagactgctatgagttaagaataatgcatagaaaatacagagcagaagatactgtgttatgctaaggtttacatattacacatatacaaaaataattttcctctaaaagccttataaacactaatttgaagcccctacactgtcacagtacaaaattctatggtaagcttctcaaatgacagttaccacagtcccgttcatctgagttgtccccacagtcgttgtaatggtcacagatccatcgcgagggaatgcactgctgattgacacatcgaaactcgctctctgtgcactcccggggagctggaaaggaaaggcacctggccatgagtgtgcaccaggaatcacatacaggagacatcttgtgagctgaccatagtgccctgggtgcccagcaccctcctgtgtcccaagccccagaggtgtgcttgggcaaatcattcaccctccaaaactagacctttcaccttaattttgagtctgtaaagaatggcctttattaagaagtttgtccaaaggtgatctgatctctctttctctcttgctctctctctctgtttttttttttttttttttttttgaaacaggatctttcaacattgcccaggctgactttgaactcctggtctaaagtaatcctccctgctcaggctcctgcgtagctgggactgcaggtgtgttccaccatgcccagcttgattttatcttaattttttctatttcgtgaaactctagataacctcttataggattcaacattgacttttattaataaaagacaaaatgccaattggattacccttttgtataagtttttagctaactgatatttgcaggtgtagtcagcttcctaaatctctcattgcttatcgcaagtggtgatcacttttttcttccaaaaggtaaacaaagttagaatgtgtttcattagtcaattagaaattgacgcatatcatgggtcagtgatatacactctgggcagggcttcattaagcttgttttcagaacacacattgagtgtgttctgaccatctaatttgatatgatctcagcctcttggcttcctttcctcaacctccctatccaatgccttgtagtcaataccttcgactgggagagagaaactaaaacctgtcctgttaattaactgttagccctcctaaaatagtcaactattctaggaagggtaataatgcaaacacaagttctctctcctctcctatgaaggccattttggggaaagagcttaagaagcagtgtctctgggttagcacccttcctccctctacttctctggtcctggttttctatttctattctatttatcttattacatttttcctttatcataagtcacctcaacttcttttggaaaaaaaagttggatgtaaataaattcaacacataaaagatattcttcagtaaataccttcctccaaaagcttgatttgaaacatctcagaaggagatgcttatgtctttagtggaagagaaagtagaaatgtactgaccagcagaaagaaagagatcagacagcttgatatcatcctacccattgaggatcaatgacatagacagttgaattatggacaaaaagcaaacatcacagctctggtggtatataaggaccataggactgtgaacactcaccacagttttcctcatctgagttatctccacagtcattttgcccatcacactgccaacgaagagggatgcagtggtgatttttacagcggaaatcccccacaggatggcatgtcctctcctctgcaaagcagtcattgcaaagacttcataaaccattggcagagaaatgcacaaagtagtattggcttccttgtgagacagtctgagaattgtattagctcactcttgaagctcccaaagagaggaatgccagcaacattcatggtcaacattccctcttttagctaccctgagcctatcctaccacttgaaactcgatccattcccattggtagaaaccatgcaaagaatgaaatggtatctggtttgtaatttgcaacaaaggcctggtatgggaggctaaaatgatgccataataaataaatattttgatcatattatcttcagtcaattggactcagtgttcttaaaagaatttagtatcttccttacttctcttccaactaaacccaacacacatactccagatgctttggtttcaagttagactatgactaatcttgacaaattccattaatttatctggctttcccatgttaccagagagactacagatgtccaatagataacagggaaaatcagagagacattcagaatatgaaaatccccaaataagaaatatcctaatttggaaatatcctttttagagatagatacgaagtcttttctctaacccctttccaccaatttcaaccaatttataaaattagagaaacaatttaaacttgtcaagtatgaataaggattctacatttggaagaaattacacaagtttctaacatcttaataacgtcttcctcaatgacagcatgacttaaagtgctacaaattaaatacccctggtaaccctgcaaaatgctacaaaaatgtaacatgttattagaagaatcaaccatttttttacagaggtaaacaaagaaaagatgacatgggaaatacactctcatctctcatctaataaatggcacttgacatgtgcactttcttgtccctccctccactcccctgtggcccctcctaccacagccttgctcatcactgttgtccctgcagtcatctacaccattgcacacggcccactttgggatgcagcggtaatttgttttgcagctgaattctgtgaagttgtcacagagatgggcagagctcactgaaaagggaggaggcatcaaagtcagaactgaaggtacaagaaagcacctttccattgtcacattgaggttgtggtactgaggaataacaatgaccatgttaccaagcaaaccgcctctggcgatatgtgtctgttttagatgtgatctgtttaccatgagcagaaaaatagtcctaagttttctcaatatgtcagcaccactcatttgttttacagtataactttgtgggtggggttggggaaggacagggtttgaagtaaaaaacctgggttgaagtgttaggtctgacactaaacagtaatgtaaccatccacttaatgtgaacctcagtttcctcatctgtaaaatggaattggttcacacccaccttccctacctcataacatttctctgtggctcaagtgagaaagcagtagatatataaaatataagttcttggtatcatattctggttggttagacattctatgtatcaaaaggaggtattagccacttcagaaacagagtctggttccacctgcaagccacacagctatactctgccttgcagtgccagagtttgcagggagtgccaagggggagcatcccatcagctgaaaaagaaagctccatgtcctctctcagtccccatggaagtttcctcgtgtctccctgctctggtcatgccttggtcctcccacaggaacttactgcattcttcaatgggctcatccgagtggtctccacaatcattatccacatcacacttccaggcctgcgggatgcagcggccattagcacaccgaaactggcccggccggcaggtcctgctggcacagtgggaactgtcttcatctgagttatcctcacagtcgttaaatgtgtcacactgccaggattctgggatgcaacgtttgttggcgcactgccattcattggagtcacagtggtgattctctgagagcagggacatttggttatcagcttggaaggcatcaagaatgaaagctcctaattgacatcagtgaatcctggatagcaggatcatgatttctttttagaggacttatttcctaatgtacttatcagtcagtactactacatggagcacttcttcttttgactattactgtctcccaaattcttaaatatctctttattgcatacagacttaagagataagaactgaacaccctgacctgttaagcataccttcctctgtccctattctcctactggaaaatagtcttcaaactttgtgtttgttactgttattgatgtgttgtttttagtttgggggaattttattttgtgcctatttgattatttatttattttcttgagaccaagtgagtgcagtggcacgatctcggctcactgcagcctcaacctccaggatcaagctatttttctactgcagcctcccaagtagctgggattacaggcacatgccaccatgccaggctaattttttgtattttttgtagagacaggcttttgccatgttgcctaggctggtgttggactcctgggctcaagcgatcgacctgcctcagcctcccaaactgttgggattacaggcatgagccactgtgctcagtcttttttttttttttttgccttttaaatggaaacataaataaatatgacaactgagagtccctgttaaaaatgggggtggaaacctctcgtttcctcctcaatgttagctctcaaaggggattcaatgcccagcacatggtgaagagccaccagtagagacaacttattgtctacttcaaccatttgccttgtaaaaaccttaagatttctaaaaaaaaaaaaaaaaaaacttcataaaaatagaaaaaggatggagcctgagtttccttctaggactttgaactggtttttagttcatgatattcaggaaatacccacagaatcatgatcgtatacaatcaacatagaagtcggaaaaagaggcataaagcgactcaacacaccacaaagaagacggtcttcatcagacccatcagggcaattttggtgagcattgcataaagtctgcgggctggtgcagttgccgtcactgcactggaactgtcccagtcggcagaagcgctgcgggcaaagggccagttcatcagagccatctgagcagtctttctgtccatcacatttccaccagataggaatgcacctgcacagagaacatacagcacttctttagcaaagcaccaggggcaacagttatctggagagaagaagtcaacactgaattccaagaaatgacatgcatgagctctctcgtggccctagaagaggatcaattaaatctcagttacaatggtgtattttcagagaaaacataacttggcaagatagaacaggtttcttaagatccaaatacaaactgaaaatgtgctcttaatatgatgaataaatttcctccacaaaaaaaaaacaataaacaaataaagagtgggtgttttgagctgtgttctaggagcagtgattggttgagattgtctgccagggtgatataaaagtattgtttgggaagttggagggcaataaaaactgttgagggtctttctcacgataaatgtatgctagattcttaatctcagatatcttatttaatcactacaatcgtctacctctgcatcttagatgctatgatctgcattaatgcctctctccatgccactctctaactcaggtcccctagttatcaatgggcctgtggacattgttaagaaaataatctgtggccatgtttcatagcaaacacaaatgatcaaaaatggatttgaatgtgtaaccctggatcccctagcataggcagctaaggagctaggccggcatagacatggaaaagacagtgaaattctattacttctagggacaatttttcagtatgtacttatatacactctggctccaatacttaagacaattagaaatgagaaatatatggtttgcttcctttctatgaaagtttgcatatataggcataacagtttggttagcaagctccttctattcatggaaaatattatctgaagttggaggctgagagtcttgctgtgttccacatgaaccaagttaattaaccaaaatcttgtctcactagaaaactcccatcccttggagccttgaaggtcaatgtctgtccacgggctagagaggcactgaggagaggggaaagagagccttacttttcattgttagcgcacaggaactgggtgctggagcacatgggcatgcagtaggtgctgccactcagctgaagggtgcggaagtcatctggacactcgcaagtgaacccttttcctcctggcttgatgaggcagagatgagaacagccaccattgttggtaccacagggattgctcactagtggaaaaggaagaaaatatgtgttcatttgctgaaagagagtatcaagcacagattagctgattacacatcttgactttaaactcatcacctcttagtaaaaaaaaaactatcctagatttatgattttcccaaaagttcctaaataaaacagatgatagagttatacaagcaacaaccctgtgctttaagaaagctcatttatatgctaccagaagtgagctatacccactggtgtttctgactagaaaagatgtgtttctccaagtcctgggaaagcaggcagtaaacttagcttatgttcatttgcctagacctaggttaaagttttaatttccaacagatgctatattcattccctcattctaagtatacaggtaacaagtttggccaaaaataatgtggatgaataaactgagcagcatctttactaattttcctggtcaccactttgaggtgaatatttgcttgaacttctaataaaaatgatatgaagaatattaacttccagaaagaaatactaaatttctttattttgctaattctcatttttccttaattccaagtttatcatatgttttagcaagacatcacaacaaagcagacccacaaaaaccagtctatccccaaaatatatttcagacctttatctttatttcagactctaaatcataaagttgctttaattgcataaaaggaatataagttcacaatcaaataaaaacaagttctcttacttaaaaaacactaaaacgcactgctcttgacattatcttctagaagataagaataatatctaatttatacacaatacaatatcatatgcatttatttagtatttagtatttagggctgaaatgccatatttttaattcctttaaaatacttcagtcttcccatagaaatagatgaagtaaatatggcaacatgataactgttaaatcttatcaaaaacaaaggaaaaaaaaaaagatgatcttgaagaattgagcgagttttaagaagatgaagagttctaggtagtctttcccaggggaagggggataaactctaaagatatttgcctactgtcaactttcagcatatgctttgaagaaaacactaacaagtgcaacaaactttttgtaaatcacgaagttcatgcttaaagacaatcatgacatgcacataacccaaggcaaccttgccaaacccctcaatcacctactcaccaatgggctgcctatatggatggtacacatggatgtcaaatggtctgtgtgttgtgttcaccagtgtctgtctatttgatccatcatatttgtttcccttttccactgtccttgtattccaatctgtccaataaatagtgtcttcaaaaatggtaatagcgaaagggtgaggcagtgccccatcatacaccgtgtgtcgatggtggccctccaaatcagagtacctgcagcagtaagcagaaacagttatgtgataaaggtaattcctctcctctaatgtcttgcaggataaaagaattcacaaatcaataaaattctacctcctagagataatataagttcagatcctcaaaactcctagtctttaattaaaacaaaaattaaacttaaaggatgaattcaaattgaacaaaagatgtagaagtgaaaaagcaatacttaacaaaataggaatagtgtcaggagtttaaataatcactaattcctaaccacagctgctttcctgcggatgaagctgttatagctgttgtaggtttatggcctcttatagtgatgttcctcattaagcacccttttgatatcctggggtgaacaccattcttgtttcttccaacaccattggaagaaatcagaagatagcaatattatactggaattctaccttctcattaacattccggaggggacgttattctaggagatagttgcattctcagtataacctgaggggaacacaacttacaggcctgcagggttaactttgcaaacaccagcaggacatttattattaatcgtgccatggcaccattagcgaatacttttacagatgaataaacctccagagaaggttctccgatttcaagatgttacaaaggatccacagccaaattcccaagtcctctcagttccaagggctttcattactgtgggtctatatcagaaatcatttctaaaatagtgaaaatttaatattttaaaaatttggaacagatcctaaaactcaaacaggagatagaacaagctagcaactaagaaacctgataatgttagccatgcaatgttaaaaatatttcccaaaatataatttatggtaacttataaaagtcataggaaaacttgaagatgtgcttggcctttgttgataaggatgcaggtaaatgaccagaaattagtcaccatctgatttatttatttatttatttatttatttatttatttatttatctagagatagtctgactctgttgcccaagctggagtacagttgcacaatgttggctcactgcaacctcctcctcctgggttcaagtgatcctcccacctcagtcttctgagtagctgggacaggcaggtgccagcacatccagctaatttttgtaatttttgtagagacagggtttcgtcatgttgcccaagctggtcttgaactcctgagttcatgcaatctgccctgctcagcctcccaaagagctgggactataagtgtgagccactgcacctagccaccatctgtttttctaaaaaaatcatagaccagaaagtagtcctgagaccttcccttccagttcatctgtaatctctgtagagagatctcagatatctctatgagtactttttgtcaagagtagaactacacagctgggtgcagtggctcacgcctgtaatcccaacacttagggaggcagaggcaggcagatcacctgaggtcgggagttcgagaccagcctgaccaacatggagaaaccctgtctctactaaaaatacaaaattagccaggtgtggtggtgcacgcctgtaataccagctcctcaggaggctgagacaggggaattgcttgaacccaggaggcagaggttgtggtgagccgagatcacgccatcgcacttcagcctgggcaacaagagcgaatttccatctcaaaaaaaaaaagtaagagtagaactacaggcacagctccagtgatgtgttggtgcatcccaagatgtacaaggaatcaattgcatgctctataaaaatctattgctttatgcatctatgaaatatatttctgaacacaggcattgctacctctccaagaggtaaccaatttaacatggctcatgaatattaaagtttcctttattcccagatcacagtgcctcatattatgatttgacttttagactaaaatctactgcctaaattttataatccatctacgtaaataatctatattagattttatcaaaaagtgaacagaatattgtgtaactagaaaattccttttttcatctctaatgctcctggaaacactgtctaaatgtatgctgagtgacacctactaagctttcaagaccaagaataatctataggacccaaagaacaacaaatgtcagttagaaagttgttgaagcttctttgaacatcttgatgcttctactaattcaatataggattatatggaaagctaactcagctctttgatgtgccttttaagagaggatacacacactgtgggaagggctaagggtattaccatcagcatatcacatcaaaatggtataagtaaactagaaataatattgtactgcttctaattaaagttagtctctaccctaagagtgagttaatatctgctacggtaaattctgcaatgagaatgctaaaggctaccttagtgtagcaaatgaaccagttcaacaagagaaagtacttggattgattaattatgcctgccatgagcacaggaagaaagagcactggcgtgtgtgccaggtattccttctttttcagtggcatgtccccagggagcatggtgttagagaacttcaaactttactacactgactttggcagcaaaataaatataacagaagaaaggaatttctaaaaataaaataaaaaaatttgaaatagttctactgaatgaatggcatttccatgcttctgagtgcaacaggctgttcctggatcgttatccataaatgcttatgcagaagacaatactatggtccaactaggccataactagcaaaattcaatatgggtattgttgtttaatttttgattaataatgtgtatcatctttttacaatgagtattttttattgaacagtatatttaacacacttaaaaattatcctattaccagaaagatgtaaatgccttatcatattggattaatgttaacagactctactgccacctaaaacactgcactgcacttaaccataaatgtgccaaagtattttagggaaagttttccagatccttttattcttttccttttctcaaatactaaaatttattaatcatatatttcataggggagagcaaattaaagagataaaaaaaattaagatgagttgcacactgagctgactaccatggggagagattattagccccattttctagataaaaaaacaataagaagtgaaaacatcaggtcataaaccctgatccatatgatttaaaagttcaccctctttctactgcaccataccatagagctcagcagttttagttagaagtgtgacttcccccgaatgacttccaacagacaggccagttagacaatagaggggactaatagactggaatcacaagctctgatgtttgaaataaacagttacacaattgttttatgcttttctatgtacgtactctatgtaacccaggtgggcatctgcccagtagagtagatcattggtgtaatcaatggtgatgccattaggccactctaacttggtggagattatcacagacttgttggttccatccatgcctactctcccaatgtatgcgcggtgaccccagtctgcccagtagaggtacctgtcagggcaaacacaaagggtcagtccctgatgccaaaagaagtcagtagccaaaatacacaccttttctccatttagagaaatggagtctgcattctgtagagcagactgcattctgaattcttttctgcattcagaaaagaaagagagctaacagcaaataatctaaaaaagaaaaaggaaggggacaatgtacagaaaatgctcacaaataaacatagttaactggatttcagtggctttgacttcgagagtccagtaaagaaatcggttttctgaaaccacagttttctttgcatgcagccaaaatacaggacttgaaaagtgcaaaagtgtgtcagggaaaagaaaacagaagagctgatgatgatgatttgaagaagccatgcttctactcattacactaaacaatttaccaagtaggaaaagcagaagacaaaccccagcaagacattggccttgagatagttacatgaacagccttctcggtaacagaggcagaagaaggaggtgaaagaaaagcccaggattgcagggagacaatacccatattgagggtgaagggcaagtcctctgggattatcaaagcagaaggtgttgttggcatccacacagtgctgggccagcatgcggcggtgtccaccattgaggtcagagacaaagaggccatccaggcgggcatccaaccagtagagctttctaaaatggagagccaggagttaaccaatacagtcactttgtgaaatggtacatatttagccacccagtttcctacccaagctacctgagaatcacagacagttgttagaagtcacctttcttcaggcaaatgagggcaggggaaaacaggaagtttgtcttcctgcagtgaggcaacagagggtgcaagactgtgtgcaataattcccactttaaggtggtgtcatgtagaaaatacgggggacacacttcattcgacgggtctggttttactttcctcatgcagcataaggcaccctctccaggcagtgcaaaggcttagcagaacagggaagcagaggtgagtatcatgaattacagtttaaatggtggagtcaaggaaacacacttgtctaagtgtgtcattgaaactgcacagagaaactctgaattatgacattcttaagataaagattatgacatccttaggataaagagacatccctgcctctgtcagacaggctgtcaaaatgagtttctcaacctgagacacatttcacttaatcaaacctaagaagctttagaaacatattaggatctgttagaaactgctacctcaaggacatttctgttataaatgtatttttattcaataaaatttatttttcttataaggtaagtgttcttaacccaaggtctttacccagaatcagggaagccagctttggtgatctgtgtactttctaaaggggcccagggctttcaccagagtcttatagcatccataaccttccaaagggttaaatgcacctatagtgagaaggtcatttaggatttgataatcaattccaaccggaaggagaatgaaggagaatgatttcccttccaaaagacctgaatgcctctttgcaacaagtacgcgcttaaccattcatgctggatatctgaatagttaggacagtagcatcgcttcaggcttcagcaagaaagaatgagtatccatatatgtacaagtcttgccagttaattcacttgggtaaatgagtaaatcctgatgaatgagatggctacaatcttggattccatcatggtagacactaagaacagtgagaataatagtagctaattattgaacacttgttaaatgccaggcctcagaccagggactttttaaaacattatattatttcagatcacaacaggcttagaaggagttgctattattattcttgtcgtattagtattcctgttgctattaccattcaagtcctggcagactggctaccccatagggcactctactctgttgagcttactgctttcccattaatttctctttattccacagtcaaaagacatcctgtgaacagattcttctcaagaaaacatggagaagatattccgtctccactactggaaaaattaagataactgagagccaacagtatcttccaatgtgcgtaatggtggtttaaaaagttatatcaaatgcaagggctttggaaaccaaacaccctaatgctgacagcagaaatatttattaatattggagaaaaaagttgtttctaatttcagtgtagctagtatcttagaactgccccctaccaatgtaaatgtaactgggctccattctgcctttgtgttttcaggaacactgagcctggttgtgcaccctcctggactttcaagaaaagtttaccctaccctcacccagactttcttgcccatcttcctcacatgtatttaattctcttctgataaagaacacaccgagatagagaggaaatagctgaaatccaagagaaacgtcattctagcagtttctgagagagagggctgaatgacaatgtcttacagttcaaatattattttttctgcagtggaacaaaggatggtgacaagaacagtaccatgctcagttctgttcctggaaatcattaatcactatactttttgacatgtaggatacgtaaaacaggaattgatacatacaataggaatgcttagtcaacgtttcatttattatccagcaagcactcagcacctatgtcaggccagctactggtcagggagaactgggaagccaactgtccccacccattttaggatctttacccttaagggagtcaaatataaggatgtggggaagagccctctggaggtctgggctgactgcaacaagaatctttacagcatacatctttacagtgcctgcagattgatgtctattgaccacaaagccaattagtttatgctgccaagaatccgatagatttgatattcaatagagatgttaagaagtgtggttcatctggtagtttagttaaaatatcactggcctgccttaaagactgtcagtttccataagggcaatctcaaaacaagagtctcatgttagccattctccagttttcacgcccagcccatgctgggaatgactagtattggttgttttttttgttttgtttgttttgttttttttgagaaagggtctcactctgttactcaggctggagtgccatgcatgttctcagtccctgcaacctgcatctcctgggcttaagggatcctcctacctcagcctcatgagtagctgggactacagacgaacaccacctttcctggctaatttttttcattttccttagagacagatttcgccatgttgcccaggctggtcttgaacttctgggctcaagcgatcctctcacctcagcctcccaaagttctgagattacaggcgtgagccactgcccccggccaatgacaagtattgtaagcaaggctatgtacttcaggagagcaagggccatgtctgccttgttcccctcaaaacccctgctgcttgtcatcacgctgggcatgtaggagggactcaggaagtaacgactgaatgcaccaatgaatgcatgaatcgtcccttcatatcatctccagttaagtgaatggccagcaacagtgaactctcttcccttgcaattcctctttccataaaaatgatactataaatttttaaaataattagatattctgttctgaatctatcatttgaatatcagatacaaagcagaaaataaacctgcagaaacattaaatgtatctgcatattaacccaagttgaaaaattaatttcctatcaagatgaaaacatggttagaattttttaatttttaacttttaaaaagctcatcagtgttttcttacctggaaacccagtctacagccagactttctgcagctggtagtctgtggtttatgattgtctccttgtttgtcttattcagaaacattctctcaatgacttgcctctgtgtatcaatccaatacaatctcttctctactcggtcaaaatctaatgccacaacattgtccagtccttccaagatgagggagtaaaaatagccatctatagttaaatttctcaaatagtaacggttgctaaaaatgagatagggttcgatgttactgttttgccggcaggtctttccatctggttctcggaggtagcctggggcacacttacagatgtaggagcctattacattctcacacttctggctacagacaaaaggcatctctgtgcattcatcaatatcaacacaagtccgcttgtcagacatgagcttgtaaccaggacgacaggaacaatagaaactggttaaggtgtctgtgcagttgtgatcgcagccactgattgaagggtcatggcattcattaatgcctgtaggtaaaaagcagttcttagagatcctaaaatatcaacgaccaactcactataatggttcaaagtcaacatttctactaaacagtgccaattcttaatgaatcatgctaagacagacaacaaagacttccaaagactgtggattattgaaaagtcactatttttcaacttcctcaccaacttactccttcatcagtggtttcaacaactaatacaggagaaatgagaaagaagaggagaagaaaagagcctggccagtgtgctggtcaaacaggactcaggaaaaattttctaaatgctctgatttgtagcatgttccagtgtgactgttcacaccatggtcaagctcaggcttccagtgtgacatcactgaacatggaaccacaaagagatacacacatttgcctctcacgagatggcatgagctcaacactaggtgcaacacaacactacatgtccctctggctggtcctgtaacacatgggcaacctcacccaaaaatgatctacagagggaggacagcaagttcttattagttctctactcatcaaggagcaatagattaaaacttcatgcattgcaaaatccattatccaaatatcaggccaagctcttccactagttcactgtgcacccccaaacaattcgtttcccatctatgggctacagtcttattatctgcaaagagaacagggtacagaagatcactagtactccttccagttgtaagagtgaatgtttcataggtttggatgagacctactgagatcacttcgtcttcaagctaaaaattttaatttgaattatgtactattgaggatttaattcttatagttgaggtaaggcaaaattaattaaaatgcaatgggaatctatatgaattaggagtaaacataagaaagttccctatgatttttgtataaatgtataatatagcacatgtttttcttaatttattaaatggtttttgaaactttggtagaaatttatagaagtttttcttacaatagagcaaaagccagtttttggatgatttttaaatttttttctttttttttcttcaacttttaagttcaggggtacatgtgcgggatgtgcaagtttgttataataggtaaacacgtgccatggtggtttgctgcacagattttttaatattatgcatagataatctcttctccacatttccacagcagtttctgtctagcatttaattttaatgttatttcatataaatcttatctttcatataaggataaaaactacattacatacttctgggtcaattaggcaaatgctttcaatgagtactgacaatgaacaagtggaataaagaaaacaaaataaatgaaaggatatggtctctaaattgttattacagagacaatatcaacatacatgaaacaatggttacaaggattaaacaccacaaacaggacgaactgccaatattatggagttcaagatggtgctaagcaaacaatgcccatgctgtggattctcaactgctttacttgtggtggttggggtgagagagatattaaactctcccattcaattacctgaggacaaaaatgaagaacaggccaacgagttctagcagagggatgcttcaggcaaaaagtcattacaagaattcaaagagaatcaacctggttcccttcattcttgagtaccttatttggcaataatgttaaatgatggcctgaatatttgcccatcttctgttctctctaatgactatctaagcaaagaattggtccaaaaaaatgtgtgtccccatcttatataccaagaaactttggtaaccttttgctatatcaggaatagtgattttatggtaactttgtagttagaggacaggttggaaagtctaagtcgtgaagggttgagaatccatattcagtctcccctgtttccttttcccaaatcctctgttgtactcaccacagcctttctcatcgctgttgtccaaacagtcatctaggtggttgcagagtttcatcatctcgatgcagcgcccattgtcacacttgaactcgtgaggtggacacgtgggttctggggtgtggcacaggtgcatcagctcatcagatccgtctccacagtcattatcctcatcacagacgaaggttttactaatgcagcgcccgttctgacaggtaaactgattctgttggcaagtctggtataagcagcccctctcgtcgctatagtcaccacagtcattgtgccggtcacacctgtatcatgagatccagtaccactttcagagaggttggcaataaacctcaactattacccacttggggttttgcttccttctttatctacctaaatgccaggtcaaccatttcgacaagatcaccagtgtccttgatcccctttcccccatcatcttcgtctaccccactaatcgccaattctagaagaatccaatatttggcattccacacaacttcctcaggggctggctgctaccattagaaatgctaccattaaatgctaccatttaatagctatagataattagtaggtctatagctattaaaaataattgcattcattttttccttagttgataaactaattaaatacaacttttgtaattttggtatacatcagatctatgagacagcttatgaacagtggcactatctatgttcaacagataatgagatagccagtaggcactggcaatgtactgggtaatcacatgataaaagtgcccatacccaaatggaaactcatagggtgagtgctatatattataaataagattattgggtgtgtcctctaagaacacatatcttcccactggaataacgtttacattgtcagtcctgttccttccatctttcattacactcctgccatctatcatgagatgtgagtcttcatggtgatgtgaataaaggcaagctagtaggttagcatggcatactggcaaaggaagaaggcatgctgtagtactagaagctatctcgggacctaacatacacaggcatcattataacaatataatttcctgaagttctgtgagccaaactggcctttcttctccatattactccaagatcccataaaagttatgatgtctaaagggggtctcacatatgcatcaaggaatctttgataagagtgaacaaagctaatggttttgaacaatttatcatagaaagcataggagcggcacatagagcattacaaaatgtgaaggcaacaacggtgaatgtggtcagttttacaactgacctataaccaggcctgctaaccagcactgccatccataaacccagggccttgtcaacatgatttacagcaaaatgtgtgcatgtaattgtgaagaaagctgtggtcaaggcagactggctcagcttcatttggtctcccgggagctatttaactcatttccaaatggtttgaaaacaccaatgttttcctttgtctaatttagatccaatgcaggaggaaaaacaagtcatcaagcaaatcaccaagctttcagacactattgcaagtcagtattccagctcatcaccaaattgtcacccctcagtcttatcatccatgtttttcagcagcatcagtagtgagccaagaaaaaaagaaggtcaataggaaaaatgatctcctgtcccactgtaccaaatggggagcacactttctgccaagcaagcaaggagatgcacactaacagcacacctagtagaggctactccagacacagattttggacttacttagaagctgatagctcaggttttcaaacaaacagtatttttttttctcttctactatagcccttttcaaggaaattcagaaagctcaaggaaaaaaagaaagagagagagaaagggagggaaagtgaaggaaggaacaatggacgaacaaagaaagggagagaggaaatgttactgtgctgtgagatcatagtaatgataaaggaagaacccagaaagctcagaatgggaggaataaaggagataacttggagtctgatcaaaatcaacacctgctaccattcttgtgcctagagtctaagcctaggtattcagaatatatttacatctaagactaatgctattagctatttaccaaattcagaaaaactatagaagtgcaacacaatagaactcttgagcagtagggagaaaatatagacaaagatttatccactttaggtgcaaaaaataaaaatctacactttacattcatattacttaaatacaaacaaagcatattctactgcagcttcactacaaaagaagacagctccacctcttgaatgtctttgcattgtcagttcacaaactaccacctctcagcaatgtccactcatcagaggatgaatcacccacagagtgtattttcctgatagcatttatctactttttaaattactgctgagtccctgctccttcacctcctccttcttcctcaggaccaccacaataaacacacaatcgtacaccacactggactccaacggtacattagcgcctgttgatgagctgcctgcccctccagtcaatggcccctgtgactctgcttctctgatcttgtgcctacttagtatatctttcccactgtcttccttcgcatgctgtaaggtggccattcctgatgctctcaatgtgcctgtgtgtgtcccttaacagtccttggcacaagcaatatctcttcacggctccagttgtgcccaaatacctaagacatactttcacctcaggaagtcctactatgtcaaactcaccttccaccttgagcaagcgcctttctggactcccctacttttgctaatgctcgtactattttcctagtcaatcaggattgaaacttacaaattgttcttctccatttccttccataatccaagtatttgttaagtgggatgatgagaagttgggatgttaagaatgtatataaactgtttgaagaggcccatttggagaaagaggtaagaagtcaaacaatggaacattgcaggagaggtcccccaaaccagcaggctgtgagccgaatctgtttgatccacacagtgttttaagaattttaaaatttgtttccagcatttaaaatcagagtatttcaaatgaaaatccagatttccaacttctgtcaaaaagagagcatcagaaagtctggccttccagcccttctgcatgatattgatcaatgtctgcatccttagttggagacattgtctcagttcactccacctgcctctacttgactctgagcctaagagccaagctctatttatcatcatgcttgtgctgttatttttcttgtagtagagagaagagagtgaaacagttcttgtaataccaatgcctctactccaagtggaaaactaagcgggtcaccagcttcaagaaagaattcttatctcaagccctatccattcatctccctggccctctgtgcaaggccagattctgtctttcacaggccctaggcatttttgccttcttgggttccttcctccataaaaatattaaaaattatatttaattttaaattgttaatatggtattatgtattaataattcaagtaacttcttttcattttaatgcaatcatattggtataaagccagatatattaatattatatattaaaatactttctttgatgtaaaagttttttttccctttgatttggaaaggaatccaaacattttcataagccactaaaagcatcatgggccctgggcactgtggccacggggtgcctgataggtaagtgagcccagcccccatggacatttgaggcatgctgggtaacttctgaatcctcaattcacctgaatatctttgggatacacagtccgtaaccacaggtgaattcattttcagagcaagttctcctggtgcaattctgattctcatcgtagccgtcagtacaatccacatcgccatcacagacccaagactggggaatgcacctcctgtccggaggtctgtcatttacacagagaaactcggaatccgagcagttttgattctctgaaaccaaagcacgcaagaatcagaaagcatgagagctcagtgcagcagttaattctctttgctttaatgttacttaccattctaagtatgaaaggaaatgggaggaaaacacgtagacaaattacactgctattataataatagatcataataaaaatacctccaaagattccattttaattgctttggaccctggctttttcaaagaaatcaatacaataaaatgtctcatttatttttccataaaatacattagaatggtcatactttttcccttagggcttcagaaaaccactaccattttgttaactggataccgaatgccttatattttggtaactttttttagtttacaaagtataatcacacaagcacaatgtgaaataggtatttttacaccatttgtatagatgagaaaactgaagctcaaagatggttaactggatgtctcaaagtcatagaactaggtgaagagctggggcttcaaacctaggtctttctcctccaaatttagtgcttttccaactacattatagctaccaccccaagcaatattggggtggagaggaaaggcatatgctaacagagttgtcagaaaccatgatgctatgaggaaagaggtgagatgctgacatcaaatcattagtgtccacaaaataaaagaacaggggttttatccagactcattgcaggtgaataggaaacaaaagaaagaagatgatgttggtaaagacaggtgagagaaatgcatacaccacaatccatgtatgtgtagctgaaaaccacccatgtcagtggatagggtggatagggtaaatgtggagttgtgacccaccaccaaagtcacaacacaggagggtgccatcagatgcaagcagcagggagccattgagtctattgccctaccatagaaagacattattctaacaccgattagattaattcttgaactagctaagatttccataccctgttggtaatgaaaatgatgttccattatctactcaagaggcataacacccctccctccatgccgctttaaggtgacaaaggaaaccagagacagttcattgttatactgtgaaggttgctattaagagtggccaaccactgggtgcagtggctcatgcttgtaatcccagcactttgggaggccaaggcaagaggactgcttgagcccagtagtttgagattagcctagccaatatagtgagacttcgtctctacaaaaaaaaaagtataaaaaatcagccaggcatggtggtgggcgtatggtcccaactacttgggaggctgaagtgggaggatcgcttgagcctggaaggtggaggctgcactgagccatgataccgccactgcactccagcctgggcaacagagtaagaccttgtcaaaaaaaaaaaaaaagaaagaaagaaaagaaaaaagaaaaggagacaaccaagtatttgtgggttttttttttcccctagaaatgtaggacattatgtccattagccaaatgtaagagaaagaaagtaaacataaagtcatttttcatcactctgaagcatttaagtggatgatatcaaacactcccagcatggagaaacaaaggtaacattctatcagtgtccattcaattacagagaaatctgcaatcatactctccaaacacagaaaaacaactctactgtgtttccctggaatgtgactctgcagaggaattaattggcttcacttacgacactggtgccttttatcctcgtcactcatatccccacagtcattatcaccgtcacagatccattcgcttgggatgcacctcccaccatcacacttgaactcatcagctaggcatgttcgctcagagtgacctgaaaagatcaatagcattctcagtgaaaaaaagtggtttacagtccaggaatctggagacaagctggttgtagcatgggttgtctagaaaacctgaaacagagcattatttaattatatacatctagggtagtcctccaataagactagtaccagcgaccaacagtttgaggtaaaagtagtcaactgacagtgcaaagccctaattatctttggtgactaaaatgagatacaatattcccttatgtgtatggtagagaaagaacacttcttttcccaggaaagatatgaattacctactatttcacatgtttctattttaaaatctacttttcatccaaaaccattttgttttgtgcaaagtctcccctcgcctgcactccccatgcccgcttccttgctccctttccttctttccataacacttagcaccacctttcaacatactagacaatttactgattggttgcctgtctcccctctttagaatattagctccatgtgggtagggattgttgtcttattcactgacacagcccaaaagttcctagaacaccactgttcaataaatactgaattaaaataagtcactcttctacttcaaattagccatcactgattcagatgctctaaccctaaccccacatgttcctatttaactaatgaaggtgtcataggctcccaaacccaggggaccctggaattagcctaaggcaagagaaagtatagttgcaactgataaagacacagcctatatcataacagtaacaagaaacaggctctttcagaagctgctatgaaaagtgtgtacattgatccagacttttttttttttttttttttttggagacagagtctcactctgtggccaggctggagtgcagtggtgcgatctcggctcactgcaacctccgcctcccaggttcaagtgattctcctgcctgagtagctgggattacaggcgtgtgccaccgcgcccggctaattcttgtgtttttagtagagacaggtttcaccatgttggccaggatggtctcgatctcttgaccttgtgatccgcctgccttggcctcccaaagcgctaggattacaggcgtgagccaccgcgcctggcctgatccagattttttgaagagacatatctcctttgatacagcagcaccatttctggacatctagaccataaggatctttccacatgtgcacaaaggatgttcaccctgacactgtttttcatagtgaaaaaatggaaacaacctaaatgtccaaccactaggaaaaggataaaaatacatggaccattcgcattttaaaatattctttggcagtgtacaggaatgaggctggtctgtatttgctgacatgatgttaagcttaaaaaataaaagctaattgcagaaaatatgtatagtaagactccatctgtttttttaaaatctatatatcaagatatataaaagtaaagtaagatatataaaagataaaagtaagtcaaattcacactcaaccttttaatagtgattacctttgaggagtgaggggattggagaaggatgaaaaaatgtaaattttacttttttgtacatcgtattatttctttaaaatatatttctgaatattattactttactacaatgaggatatattcatatatagattatgtgcttatttttatttaaatatatcaggtcattggtactcactgctattactatggcttttgttaccatagagaagtttaaaaactcatattaattattcatatatttgaaccaataattcatacatttgaaacaatctctaagactattctactcatccagcagttattagttatttcctttacaggtcctcaaaactctatgtgccctttgctttctataaaactttcagtgttggggaaaaagaacttagtgaagcactccaaataccactcttcaacacagaatttaaacctgagagaaaactggaattgaaaatagtttgacttcagctataaaactatactaatgatcctaagaaaatatcctgaaaataaaatgttttaaatacgatgttaatatttactgcaatgatatatactatagaggaataaaataaaagcaacctaatgcttaataatagaggcagttaatttgatgatactataaccactcaatggaatattatagtcattaaaaggcagtatgaagacaaggacgagcaaactttttaactagatagtaaatattttaggcttacaggccctatggtctctgttgcacctacaggacgtggccatagtagagggacagcagccatatgtggctgcatttgagtaaaatgctatctataaagacaggcaactggccacagccatagttttctgactcctatatagcaatatgatttattgacaggttttttaaagcaatgtagaagattgtatttttatatttttacaattatgtaaaaaatgtgcatggatatagattagaatttgtgaaggcaaatagcagcctccaaatgtaaacagggcataactgtccccaggaatacaaccaaaggctcctgcaacttcttgggcctcttgtgctcataaactggcacagagagagaacaggaagaggatgcatgctcctaatatactccttccccatgtatatgactccaatcacttttaggtcctctgacagctttctgggccagcactcaaccaaattcagaaacttcaattgagagccaactaaaattaagttctaccagctaagcactgtattaggtgcatcaccaatataatttcattttatcagcatcaatcagcagcttccgtatcctgatcagctccccacacagtgctctccactaacaggtcttaatgaatatccgctgagcggtgtcagcattccagatgaaagctgggacaggaagtccaagcattcagcagccatgaccctggtctgtatttgaagcagttggaagagactgaagttgtctagctgcatcgtgatgtttttcatgcttgcttactctcttaccacaagaggcaggttcatcagaggcatcaaaacaatctgtttcttgatcacaataccaatgttgaggaatacagcgcccagatgcgcattggaactcactgctgctgcacgtgtgagtggctgcaggagggaaagaagataaaacccatgagcaaaacacaagcatgttcccatcagtcttaacaatctgcctctatctctgagctagataatagttaccaaaaaaggaagactgagcctggaaaatggatgcttgtgtaagctttctgtggggaggaagaagtatgggagacagaaggaagtcaatcctgccccaattccccaatttgtttttctagattccagaaatcaaaaaaaaaaaattgtatttgttagaaataccaaagaactatctttgtgataaatgaaatcacaaattataagtcttggttttattttttctactataatgtaagattaaataaattccattgcaatgataattaaaagcaaaacaataatgtgatcatatctaagctcgctccacacacaaccttttagctatgttagataataactctagaaagttggcaaagttatcttcgtattcatccttggaataccagacttttagttgagtaagtgggaaactctgcctatgtttgaacattgactcttttctccagtaattttaggtagctctggttatatgcattttccaaattgttatgtgggtgcacatctaattaaagtcttgtaattcttctggtctataaggccgttttgctttggcccctgatatctgatgatttgccaggggagaactgacaatggaagcagaggtccctgaaaagtcagcaataattcctatctgtctagccctatctggtggctgcaacctgaattctgcttccttgtgctgctgttattacaacagattcctcttcctgtgctgtaccctaatttggtgacaaataattatgatgccctttgatttccttgggaggggccagtgacaagagtttaactacatatacacagaacagggaagtccaatcactaaatccttaaattatgtatctatttacactaatagtctcaaagttatcaaacttaagaaaggccttttaatttgagctataaatacaggaaattgtttgaatgaaccaaattgctaaatacgaaatagagatttctgaaattccaacgtatctaggggatataaagatactttcagttactggtcaggcacggtggctcatacttgtaatcccagcactttgggaggctgagatgggtggatcgcttgagcccaagagttccagaccagcctgggtaacacagagaaaccccatatctacaaaaaatacaaaaattagctgggcatggtgtcacatgcacgtaatcccagctactcaggaggctgagatgggaggatggcttgagcacaggaggcagaggctgcggtgagctgtgatcacaccactacactacagcccaggtgacagagtgagactgtctgaaaaaaaaataattttcagttactgatggccactataataatattaagagtaaattataagggcttaacgggcaaattctgcctaagtacatgaaggcaaaaggctttcaacactgggagaaatggctctccaatagtagcagatctctggaagaaatattcagggtctgggaattctagccagggaacagagagaaagagtttctcatacccctgcaatcacatatgaaagcaactgcctaccacctctacttagaaggtcaatgtgaaatgacaattgaaatcagcccgaatacccacgcttcatatctttgtattagctcacaacatgcatctctggaacgatagaaagaaagcagttttatcttactcactgcaataagtagggttttcatcactgttatctccacagtcattgtctccgtcacacaaataaacgcgaggaatacaaatatttgaattatgacattttgtgtatccagactggcaagtgcgatcagcttgaaaaagacaaccagataaatattaggaatatatccaccaaatatgtattatgaacagtatccgtgctaacacatctattgtggaactcaaaccactggaagggcggcattttcaaagccatcagaaaggcaggatccatgatacttatgttacctatagattctgtagtaaaaaaacatatttccagctgatactggggagaagggagaggagacactggtttgtaacttaaatcatctgttttcattaattaatagcatcaacaagagttccaactcttggtaaaataaactatggcatttccacacaatggagtaatatgtagctattaaaggaataaagaagatttctatatactgataagtaatgacagtataatcttcaggatatattgttaatagtaagaaagcaagattcaaaacagtaggctaacttttgtgtaagaaaaaggacgatataagtgtatgtgtgtgtgtgtagcaagagagagatgcttatattaaaaacaataacaacaaagaaaagataaactaacaaaaattgtcatctctctggatagactgagaagagcacagaggaagcagaaaggagaggaagaaatgaaggacttctataaatgcacctcgtcatgtagttttaactttggaactatgtatgctattttgtacaaataaaatcaataaaataaaataaaatttggaaacagcaatagataaagctaactatatatcaggttgatagcataaccctgcagaaaaaaaaattccaaatatctttaaagtcatacctttgactgcatatctctagtgggacataatctaaaaagcaagaagaatctcgcacttagtagacttattgttaatagtattctttgagtggttataataatgttgaaattattataggcattttgaaattactatataataaaacaactaaatgtcaagagaaactatgattttaagcataagaagagatgtcattataaaatctaaaatgtaaacaacctgtaatcttaaatttcaatgggaaatatcaataaaaattttttctggccgggtgcagtggctcacgcctgtaatcccagcactttgggaggccaaggtgggcggatcatgaggtcaggagatcgagaccatcctggctaacatggtgaaacctcgtctctactaaaaaatacaaaaaattagccaggcatggtggcgggtgcctgtagtcccagctacccgggaggctgaggcaggagaatggcgtgaacccgggaggcagagcttgcagtgagctgagatcgcgtcactgcactccagcctgggcgatagagcaagactccatctcaaaaaaataaaaaaattttttttccttaaaaactgtatttcctagctctgaccattgaaaaggactagaagcaatgaaagctaagtaggaatgagcaactcaaccctgtgataatttctaagtaccacaaagggaatgaggtctccttggataagtggctaattccaggactgggacaggaaatataagacaagcttgagctataagaagatggattggggtcatgccaaagaacagaaaattcaagttaaggactcccattggcctaagtttggacaactgggcaccaagaaaaaacagttgacagcactgtattaaaactcatcaaatacatgaagatcaaagagttcaatataatactaaactaaactaaactaaacaaaaagttaattctcctttgtcaccaactcattactctgaaaattgacaagcaaaaggtatttatcctgtagattctaattaccaacaaaagctggtaagggaaatgtcttctttatcaaacttcagctaataaatgcggcaggaacactagaattctaaagagcccattcataactcttaaagaaataatgggtttacggaacaaccaccgatggatgctaaaaccactgggtgaaaggatgatgggagcttcataagagatgattcaggctgacaccagaatccacttaaagtggggcaacaaaacatcatgtgcctcataaggtgatgcaacaggaaaggcacagctccacctctgaaatactcttacccaaagaattgcacctgttatgatcaaaactctaggtctacataccagttcataggaaataagagggataagataaattaaatggatcaattatgcaattagtcaagtccagaatgtgagatattctacaggacaaatcacctaatctttctaatgaatcaatgacattaaaaagtgggaagtgttgtggcataaaagagattgaagaattataacaatcaaaatcagttgtagatctcatctgaaccctaacttgaacagagaacagtaaaaatacattttggggataagtgacaaaatttgaacatggactaggtactcagggatatttagtaagcacttttgattttgccaggcattataatggcatggtagttattttccaaaatgttatcagtgaagtgcatgactaggagtcactttaaaatactagaaaaaaggagagaaaaatgaaacaagattggtatttgttgatacttgctaccgcgcctagccaaaaatttacgttttagataaatacttagggtttttatttttggaaagccttttttttatataataatttcatctcctgtgatccaagacttcagacccaaaatcacaataagcacttaagataaacttacggcaatttttctcatctgaagtgttattatcatggcagttgtctacaccattgcagataaactcacgaggtatgcaccttctgttattgcacataaactccgtggtggcattgcagtccctgaacaggcaccctgcctcatcactgccatcaccacagtcattgtagtaatcacagcggtaagagtattggacacatcgcccattggcacaggtgaaggctgtcggtgagcaggtgtgaagtgctaagaacaggaaaaacatgagaacaaaccctcttgattaaaacattatcctaatttttaaaaagatacaattaaataaaagagacactttgaatttaccttccaaggcaaaaaacgctgcaaaatggactgcatgcaaagtgagataacacttttaattagttagattaagcaaaatatgttgtatacatttttaaaattgttttaggcacaaatcaagtaatttaagcacaaatcaaagtcattctgtttctctataatctcaatttatctcaatcacaaaaagcatgcaattatagtttatttcaggaaaataaaaactcctagcccctatcacagtctgctaggaaaaggtaaccaacctcagaactccctgagaaagtccactgtgttttattcactctattcagatggaagctgaggattggaagttattttcataaaatttttgaaataatgacctttgtgctacgaaaattggtaaaatgatacgtttccttagtcccaagctaagctagacttagcttgcaccatgcctcatgctaagggatttttacatattgtttctcttactcctcgcaagaaccctagtagtagctccattttacagatgagatgtctgaggcttgagatattaagtaactttcccaggtctatacagattacaaatgcgatcaccaggatgatgattgtgcttgtgctcttaaccactacagaggtgatttaacagaaacagtctggattatcagaggaaacatttttcagctctaccaggatgcctaggcacacatttcaaacacattcacacatagcaggattccataccaaacacttgacatcaagatgccattagctcctaccaaaagcgccaagagtccaactcaccacagacactttccatctcatcactgccatccccacagtcgttgtcattatcacacttccactcttccgagatgcagcgcccattggagcaggtgaaggaagatgcaccacatcgttcaccattgtccacaatgcagtgcttcctgttgttggccaaataccagttgccctcatgtggacactggcactcggcaccatttggacctgaagaaagataatcccagaagaagtaaaagatggatgcagccaccgttcacattgacccctccacaatagcacttgcaacagcttctacattaaatgctccctaagaagcgccatggaagttctgcccattaaccttttaactatattctgagtcacttttccatcaagaagagcaatcaccaatttctaataaatgtgccgattccttctaaacaacaggaaatatcaacgactcttctcagcaaaatttgcaaagcaacaacatcaaaaggcacatcttcccgtgaatttgttgttctttataaaatgcacaatgaagcacatatgatcccacccgcaaatatcaccagaaatatttcaaactataaataatacctcttaagcagaaaatgtaaatccttttataaggaaggccagctcattgacagaattcttagtcaagacatgaagtagggcagccaaggccttcatctttctttctaactccatcaagcttgtatttaaaatgccttcataggctgagtgctgtggctcacgcctgtaatcccagcattttgggaggccgaggtgggcaatctcttgaggccaagagtttgaaactagcctggccaacatggtgaagccccgtctctactaaaaatacaaaaattagctggacacgtcgtgtgcctgtagtcccagctactagggaggctgaagcaggagaatggcatgaacccaggaggtggaggttgcagtgagctgagatcccgccactgcactccagcctgggcgacagagtgagactccgtctcaaaaataaaataaaagaaaatgctttcataaaagggctccatatagattagaaaagaagcctgccaagtcttcctctcaaaatatagccccaggtctgtttcataaattaccctgacatcaaggagaatttgaattttttctcctgtgagaacttcagctttccttaccaattggtattgtgatcattattctccatgttctaattttcatggtcagtgccttacctggtgcacagatatggctgcagcccccattaaactgttcacaaggattgttacactgttgtttctggttcttcacaacagtgttgattcccctgggctgggagagcaaatttgtggtcattgcaatctgacctgacccgtcatatttgttagctcggtaaattctttgtgtgtacaagtcagtccagtaaatatactggccatagagagtcaagccaaaagcatgaacggctgcattgacaatgacttcacgatccacgcccgtcagagtgctgcgttcaatcctctgcctaaaatgaagcaaaaaaaaatttagaagttgaaatctcaagtgagttaagttttcaactggcagcccaatgcatgcgcctcatcattgtttacacaagctgcaaactttcttttcaaatggggcatatggcagctggaaatgtttcttctggtgatgggaggtcttgtttgcttatcaaacaatagcctatataaaatcattgacttccaaatatgaatagtaatcctacaaaaggaatcaggttgatattagaaacaggaaaacatgaaataatccatgtaatgcatggaactcagtgttaagcacatagcagactctcaataaaacaataacttttccatcccacttccttagtgactttttcaatttgatgtttattgagtaccttgaggtgtttacctagaataatccaagcttagactcaaagcatcactgctttgtttcaaataggagaataaagaaaagatcaggaggttaggtcttggcatcaaaagactaaaattccaaagaaatatgcaagaaaaattaagattcccgatatgtagacaccagccataataaacaaaatcatttcatcccttcaactattccattaggatgactggaatgtgagacatatggggggtacttggagaagttacatacaaaattagagttgacaaaaggaaaatattaagaaatgcgctgaggagaagcttgccagagaagaaagggtctatttgaaaagatgacaaaaagtcaaagactgaagaaaagaattttctttttttttttttaagaaaagaattttctaaaagacattgaatgctaaagcccagaaaaaaacataatatcaattggcatttaaaagtcattcagattttatagcagttacctagggcctgcagaatgtaagttgagtaatttcatttgtaattctaaattgagaaaatacatttataattatagctgaaattatagatatatttagcaatgcatctttagatgtcttttagttcataattattcaatgcatgatatagataaattttcacagtatgttcaccaagttccaatataaacatagttcctaaaactgtgattctatattctggcaatgtctatctggcatgctatattttcatcacatgatgcaaatccctcttctttggaaatggaagaaaaacctcttcttaacacccacatgagtaaccagagacacctacagactagcatccacccagtagagaaggtcctcttcatagtccagagtcagcccactgggcatgaccagactgctgttcacaatgggtacgcggaagtttcctcccaatgtggctctctcgattttggcatgtgtatcccagtcagcccagtacaggtacctagtcatacaaaaggagtcaataattaattcacagggaacctcatagtcctttaaaaaaaaaaaaaaggacaatattctttaattgcaaattgccagtaacatggcaaaagaaacttcatttctacttacacaacttgtccaaaggagatctagtaagtcagggtgttgacttcctagtatgttgccaacctttctgccatcaaagggagctatgcgctgcaccctccttcccacgtaaaatcactcaatatgctttcatttttgaatctgtagccatagttttataagcccataacacattggctatctatgaacataatttcaggccccattttttccagaaataagcagacagaaatataacaaggaagatgatggcatacccttggcagggatctaacacaattgctcttggttttggaacgcgggctatcacagtgcggttagacccatcttcagccatggaattaatcatctggttgaggtagtcactgtaataaattcttctagtaatccagtcaaaggcaatgccatcagcagtccctatacctggacacatacaggcagacacacacacaagcacacacaaagacattagagtctcatatgcattagaaacactcagtcatccatgtgtgttgaccccattgtgtctacttgcaggacaagcagcacctggagtgcacttacctgaagcaatgacagttggagtatggatccctgaagacagggtggcataggaaatctgtccaactccagaggctaaattttgtgtgaagtagattctatcacttacactgtcatagtctagagacatgacagttctttccacatttattgtttggaaaggtgggctatggttttcagggtccaagtgtaagcttctcaaggaattagacaaggcaaagatgaggaaattttctgttgaaatggcacaattcttgccatcactttgcagggtcccaaaggcacagtcacattttggggtgtgcaatccaggcagagcaaagcagagatgagagcacccaccattgttttccaagcaagggttgttgttgacctctgctggtgaccggggctggacttgcttgtcaaagatggtcacatctcttagccagttgatattgtctcttatcactgtgggtggctctgtgttctctggttccttgctggcttggaagatctttttcaaattcctatctacccatatgatagaattttcaaaaacagtgatgccataaggagttgggtaacgactgccataacgaatcacttcagagttctctccattgatacgaatccttgcaattatatctaaagaatcatcaacccaataaacgtagccatcacttcggtccactgccaagccccgtggtgtgacaatgccctctgacacaagcactgttcgattggtacagtcaaggaaagaacgctcaatctttggtctctgcccatagtcagcccagaagaggtatctgttcttgggatctacaacaatatgcctaggcatgtccactgtgactttaagaagaacacggcggtaagtagtattgatccgcagaacttctatcagtgtttcagaaacaaaggcattggtgaaataaagatttcctatgggaaaaatgaaagtgcatgctgatcaatggagaaccaagaagaaaaaaagggagaactttacaaattcagaacaaaatatataaggttgaagtctgggtcactatatgttgtcttttccaagatgatagtgtcccagtctaggcttagaaaaataagttcttactcctaggaattatagagattgtgtcttcaaatttagagagaaagtgcctatcttcagcttctaaagtagattagaattcatagcaacatcataacccactttctactgaaaggtatattttccagaatgtccctccttttctatctgaagctctaaatgcttaatacctacttgaaacactctaaatatacattttcatagcacaacttccatcccaatgtgataaaagtagcaaagagggagcaccagcagcatctcaggttgttattaatgttatcaaatggtctttgaacttaaggttaacatgaagtttttccttagtctttctaactaatgtaggtgttttcatcccatggaccttctaaaagtgaccaaaagtccatttccctttgggccttatgtacatgctagaataaaaagataactttatgaagatagtataataagtagagaatgaccacaaattattgatttcatgtagttgaaagtctgttgttgaactatcaatgctactaccaagacacacatattttgttcctatatctgattcaaaccacctctagagaaatcaggccaatgtgaaatatgttactgatacattttttcattacctaactctacttgctatgtatgcatttgctcatttccaatcctttaatccagggttggcaaactttttctgtaaagggccacataataaatattttaggctttgcagagcatatggtttcacaagtactcaacactgccactgtaacatgaaagcagccatagacaatacacaaataaatgggcatagctgtgttacaataaaactttatttacaaaaacaggcaacaggctgcatttgacgcacgggccatagtttgctgactactgctttatctataccctcagaaatagtaatttctattcaggaacgggagttaggaacccaattaaagctttatttaaccatacttccatatttactttttgcaataaactcttattatagtacttagattttcataatacatgcttatatttcctttttttaaatttttttttaattcgagacagagtctcagtctgtcacccaggcttgatggcagtggcttaatctcggcccactgcaacctccacctcccggcttcaagagattctcctgcctcaggctcctgagtagctgggattacaggcgtacgccaccatgcctggttaatttttgtgtttttagtagagatggggtttcaccatgttggtcaggctggtctcaaactcttgacctcaggtgatccgcctgcctcagcctcctaaagtgctgggattacaggcatgagccactgcgccctgcctacatgctaatatttctaagtgatgcctactcaccaagcttgattcaatgatactgattttatgtagaattggattatattccaaaacatataataccactaattatgagtggtatttttactcagatgagtgataaaaatgaggggttattcaagcttatgtgcatgaataaatacaactaagttaatataatactggaccaggcatttaaaaaaattactaataaaatatctcatgatctaagggatttttatatatgaataaaaggaagcaattaagaatttggcaactaaaattgctcagcttcaaagcaaatgaatgctgttccatagtttatatttttatatctctttctcttgaaaatttagaaaatttctaatgcagaaatcaggtgcaaatctaagtgtaaaaaaaacaaatccacataatttaatattttagccacttttgtctccagattatgttaataacagaagaaaatgataaggattaatttgttataaatctgtaaactgaaacaccgtatcatttatcaaatagacacgtagcttaatctagattcaatgtatcttaaatggtcttaataattgtctagaaaaacaaacctgtagcacatggagttaggctaaactttctagcataaaataagatgacagagatgcaaacatattaaaatcaccatatagcttacatacctgctacccaatccactgcaataccccggactccattttctcctattccatgtgtcacaatgttcatcagagaagatccatctggtttaattctacggatcgcattatcagatgccactgagctgctaaaatcacaccaataaataaagccagaggacacatccacatccacatgcagtgcgtttcgtcctggaagttaagaaaagatcattaaaaaatgctgtcactgaaattagaacttttaaatgtctgcccttcctctcaaaccctcattcccaaccccctgctctgagcatctccccattacaaaatgaaacccttttttcccagttgcagtgagcagacccacatcttggtttctactctttcccacaataaggagctctggctcccgggagaaatgttgattataggtttaggcagggaaggtacgaagtgagtgtgaaacatcttattgtaccaagaaacaaggcatacacagaaatatacaggtcgccacttgaagaggttctccctggccaaaatggatccactaaaacatcaaaagaaggattacagtaattgactgtaacacactgaatttaaaaaataaaaatttgagcccataataataataaattatttaaaaagtaaaccggggagacacgaagagctttcctttatagaagaatattatctaacaaatgtaaagggaatgctaaaataagaaaatcaccattttgcaatcctcgattaaataatcatttcaaacaaggatcatccatggctgccaaaaccaatgggtaaaaggtgcttgggagccaagacattcacagggcctaagtgtgattgcatagattccaccaaaattaagaaggaaaaaaaatacagctttaaaaagcagcagtgtagcagtgaccaccttaaccaagtgatcaaactcaaatgccactaagagcagggcaagctgacattatgttcttcctaataagattctgtatcaactaacacagcataacctataaagtattattgctaaatgtatttaaccttgatctaatcaagcaattagacctaacttccatttcatgagaactgcagggtaaaaaatgaaagacagactaaatattcagacaaatcctcagtgtgggattctcaaagacaacaggtctgcctctttaaaacatcaatgtcatagcaaaaagctagaggcaactactccaaactggaagaaactaatgagatattcccagtgcagtgcatgaatcttgattagatcttggatggaacaaaacagctatatataaaatattgtgaggccaactggagaaatatgattatgaatatttcataatgccctttgaaactgtatgctaacatatgtaggggtaaagtggcatggtattaaaatttatttttaaaaggttcataaaaaatgaatgtgaatgcatatgcatgtacacacacacacatacaaattgagagctcaaatgtgaagaaatgttaacaactgttaaatcttggtaaagggtataaggatatttcctaaatctttcaacgtttctgtgtttgaacatttttttaatgaaaagctgggagaaaaaaactattgaatttgtcatatctgtacaagatgataacttagatccataactttttagatatggaaaaacaaagatgagtcatgggtccacgtgaacatgaccatcaggcaggaggacgtgtgggactggaagctctctgattcccttctccaggtgcatttctgtattttctgaccatctctacaaccccttcattgacttcatccttttttccttcctttctaccctctatttctctctttagcctgtgacattctcctagcgatgttagaaaactcttagttcctcttgtgctaaggtatacctaaaaaccttggctcatctaggaagcaagtgatcgtttcatacattcacagtatgtaagcacaaagtgctgcaaaaatatgattactaaagagggactgacactgtgaactcttttgcttcaattcaccaaatatatattaataaatcatatttgtggactatttcattaccatattaaatagtagtataccttctaccataaatctccattaataatcagaaatagggcacagttctttggaacaccaactctgtagtacttcttgcaaacccatcctacattctatattgctctgggcctgtggttcttagcgtgatccatgggccagcaccgtcagcatgccctgggagcttattaggagtgcagattctctggccctaccctagactacaaaatcagaaaaatctggggacgaggtctggagctgtgttggcgtgagccctccaggtgattctgagacacactaaagtttgaaaaacactttaggctgtgccagttgatttaaagggaaaggaaagcttcattatgcactgaatccacacatgaagaaatgttttcatggcaccagggatttcaacctggtgccagatgaagtcaaatcttacttatattggagttggcataccttggcctgccaccggcaccatggtttctgaatgatctgacaattccaagctaaagcctctgattgcagacagcattgaaacaacaatgaaagagttatatggagagcaggaccgattatcaggattgagtttaaatccagtggcacaggcgcaggaaaacaatcctcctggtacaggcaggcaaatctgctgacaggcattcatgttgttgctacagccatttgaggattcggcggcatctaaatgaaaacaaaatccatttgtaacttttgatcctagctactcgccaccccatctcaaatttctttaattgggtcaccaaataatttattctaaaaattaataaccaacatatagtagctgagttagcaatctaaaaacaacatcggagagactagagcttatacaataacacctaaaggtatgaaaccagtaacccaactattgtataatagttagagaatggggcttcacttgttttcttctacaaatcatgcgaggattagggaggtcagtatataaatctgctcataatttgcctatgaactggcacttaaaataatatgttcagttacatgatcaataatgtgattttttttaaatatatgaaataagatttaaagaatagtcctggaattaatggcattcccagtgacttggaagaaactggagactattattcaaagtgaagtaactcaggaatggaaaaccaaacatcgcatgttctcactggtatgtgggagctaagctatgaggacacaaaggcctaagaatgatacaatggactttggggacttgggggaagggtgggaggggggcgagggataaaagactacaaatagggtgcagtgtatattgctcaggtgatgggtgcaccaaaatctcacaaatcaccactaaagaacttactcatgtaaccaaacaccacctgtaccccaaaaacctatggaaaaataaaaaaaaaagaatattctttatagtaataaaaaattaatttctattgcatgtgtttctttcacatgcagttaaaaaaatacctagtgacaaacttaggttataggacaggaaacaaattgtttgatcatctttggctgaagacgaaagctataaaatacatcaaaaaataatacctgtatcataccactaatttaaaggggtaaatcagaaattagattatctttgaaaaaaatgttgaaataggcaacatccaaaagcattctttttaagactaaaaattccatcccattagcactttcccagcaggcatccaactcatatgccctgagcaccttttatgtgccaagcactattctaatcaccgagtattgagcagcaaacaagacagacaaaatgcctgcccgtacagaggttatattctaataagtaacacaaacaatagaaaacagggagttctatgaagtaaaagcaaagtaaggaattgaaagtaatgggaagagaaagggaataaacttactctgaagtcaatctggcctttcagatgccaaattagcccttggcacttaaccatgtttaagacttcattatcattttttaaatatttcaggtaacttcaatttgtatgcacgtgtatgtacgtgaaactgtgtgtgggtgtgtgcttacaaatgtgagttatgtgtgaatatgcattatacacccatgaatgtatttcagtgacaaatacttactgcgtctgtgataaacttgaagacccctcagatttggaacattatctctcaagactattttgttggccccagtggccttatcaactctttcaatgacctcatactgttcatcagtataataaaggaaagaatcatggactgcaattccccaggggtgggaaagctggtgtaccaggatcattcgatctgttccatccacgtttcctctttcaatctaaaggattggaattttcattagtttcatggattcatagtgaaaattttgaacatttaaacactaatattctcctaattataatgtctcacatttatacagccctctatcccttacagagatttttcacttctattttctgatttgatcatcacaacgacaccaagcagcaggtcaggaaaatgtcactgtgcccctttcattgataatgaagacggagctcacatgagtcagtcaaccttttcaggtggcacggtgaagaaaagggagctaaaccactagtccctgcatgtgatattctggtcaaggatatactcaaacatctaagcgtgggccattgcacaggagctgactcaccctgagtttaacaccttcactgacaatttctgtaatggagattggaaatatgcccccaaacaaccacagaggacagcaagacaggacagggccaaaaatggtgccattaaatttgaacagataacaagctttaatcaaaatagctttggtacactggaaaagaactacaagaataaagtccctaagggaaaatgacaagtagtcagcttcttctggaagaaaaatgaaatgtagatgtagctggtttaatttcactccaaaaacctgcctcaagtgcctgctctgtgccaggatctgggctgggtattggcgagagacacagtgtggctttactgccatggctgaaaagggagcccagcagttacaagagtggttatgctgatgaaactgatcaaagttctagaatttagaatataagaaacatgagcctggaggagagagtggagagagtggaggccaggaccagattagctgagcaacctcacagaagtgttgggagctactcctcagggcaaggctccaagctgagccgtgatccaacttgctgactgtggctttatgaagaaaacatgtctccaacatgaaagcaggcttcaccactgaaggccatgcctagtcaaggccagagagaggttgctcagaatggtggaggtggcagaaaagatctgggcatgagtgacaggctgaggatggattgcagcatttggtgatgattaaaccaggagagtgaaggagaaataagggaactacactaggagaaaggttggagagtcacaccactaacaagcacgtagatttagaagctgtgccctgtcagatgtgtgtacagaaaccataccatgtaacaagagcttcctcgtcattgcacacatgcacccaactctgcaaagtgttttcacacacatcatcacttctttttaatctccaaagcttaccaccattataggtccatattcggagtgaagttagtacttgttgaacaaacaatgaactgaaagccaaacctactgcacaatattatgaaaagcatcaatgtcaaggatctgaagtaactactgttaaatagcaaggaagggactagcatatattcagttcagcacccaaagcaatgcttcatcaataattattattgagcattgtctatgtgcttagccccagctcagtgaaggtgaaatcctatttcaatgagtgaacgagactttatagtttctgcttcttattgtagaatataatgaacccaaccttggagttgaaaatcaccactaaagaaagtttcgcatgtgcattaatcatgttaaaatattagagaagaatgtgtagctacgaggggatgctgagttcagaaccttgctacgtaaataaatagatacatacatacatacacacacacataggtagatacatagaatatacctatatcctatacagatatataaattctatattctatatataatagatatatattctgtattctataaatatatattctatattctataatatatattctatatctatatagatcatatatagaatctatatagatcatatatagaatctatatagattctatataccatatagtatagatacatactctatattttttatatatatattctctccatatatataggtatatgtatattctctataattggagaacccagagtactttcaaagaaaaacactgaaatcactaaaccatgaaagaaatggctctgaaatgacaagtaagaaatgacaaatggaattaatttatcttgaagaaaaaaaaacgttggtggggaaattaataaacattaccctatagggaactatgcacatactataaagaactggacttcagctaggggcgaggtacgtgcaagggagagaagttattgggagaaggggcaatgaaacactggtacaagttaccaagtaagattgttcaagaaccactgcctgacagctcagaacactcagcatcagctacaccagctcagcataaagaccaaaagactgaaagggtgctcataccactcctcttccagtgactgcccagtagagtttctgctcttcgatgtcaagagtgacacactccaggtgttcgaggttcccagtaaagagagttttcacagatgtgccatccatgttagcactggcgatcttggcaggaaccccactgtcagttccttggtctgaccagtacagcttcctacaaccatgaaaaacaccagcatgtaacaaaacagaaggtggatttgagtcagtgacataaatgacaatgtgtattacttgtcctcaagatgctcacaatacaatgggcaaaggctgaaaatcaatatctcgttgcatacaacgtggaggggtacttcaccagtgttctaccaatgtcggtatatttcctagctataactggagtagaggccacttaaaatggtgtctggaataagaagctagggtatcccactggcagctgaacttttagcatggtcaggtgtgtgggaagcttatgacaaggaagaaacctacatcaataatccctccatcttcagtacatagtgaaggccaaagctaatataaaaagctgccaagtacactccctgatcacttaccaggcctcatttaattattccccaaatcaccatctaccacaagaccggctacttaattacctaacctgatttctgtgatgaaaaatgcaaagaattttgaaaactgacacagaaaataggagaaataatgagtaacacttttctgtgagagtggaatctcattatcatgctgttatggggtaaggaagacttcttttttctttctatttcacagcgatcaggtacacatgaaccataattaccacacagcattgccaaatccatgatatatgaaaatgtattaaaatatattaagggctgttttccatttccactgaagatgtaagttctagacttgaacccaacttttaattccttttgattgcacctccttctatatcttcaacagacaattctcctacattcttttctgaaaagtccttaaaccccttcatttaaatagtctttattcacctacctcttccaccaccaaatcaatatacccgtcctttgaatttcatcttcaactctaaacttctccgcctctaagttctcaaactctgaaatgctctgcttcgaccaaaacctctcatttcttccttgctttaacttttcctattaaacttgttctttgcccttaagccctgcctgagctcccaaccctccagttcttctacacctggacatcatatgtaaccatttcaacaatattcttatttattcttttgggttcccattgtgtctaagctaatctccaaccctgggtttctgcccttttttttctttctcctctcccatttcagggtaccaagagtttcctggacatagcacaaaactttcgtgaattctgaattcactaaaaatctaagttccctaatctaagctgaggattctcatccctagcagactttatatcatgttccgcatattgactatttcaagtcattctacttcataaatttcgaattccttccccataactttcactctcaatcaattatttcttcatccttgatctttcatctgctgctaaagaatacactcaggtttctctattctgaaagacattttcctgttacattttgacctacaagtttatctttctctaactttccaatacaaaattcttaaaagagtattcacatttcctcatcctccttccattcttttaacttctactatctctattcaacatcctctcttgaatatcatcagagaccctgtaactgcctcagctctttattagtgatcatccacaaagatatttttctgcaacaactggttcaataacatttatcacaactttatcaagactttctcttcactgagaatccaagatattagatcctcaagtctctgtcttgtttctcctcctatgtcctctgacaaaattctaagctcttctaattgtctcccaacccaactgggttgctcttagtcacttgaacaaaccctcaattttctgtccctttgctcttgaccttccatccttcatatcgcctgatatatcttaaaagctagctctgcccagtgaaattctaggtatgctttaagatccagtccaaatgatatctcttccaccaagctgaaatgtcacctctttatagcactatcatcccaatttttttagcctctcttgtggctcttaatcttatatgaatctgggttattgttatttatacacaggccttatcctccttactaagccataaatccttaaggttgcaaattaggtctttaatctttgtatccaccctctgaactccccaccatggccccatgaaagagactgcctccacttgccaaaattaatgtcttcctcttctctctgggtaaataggtggactgcatgtccttccgtgcagttagctgtggccatgtgacccaattctagcttaaggagtgtgagcagaagtggcgtgcactacttgtaggcctggctcataaaaacctcccagcaaatttctgaacgttctttcctttactgctcgaaagatcttgatactcagaatgacctaggaagcctcctactgaagatggcagagcatccatcagcctgggtcctgaatgactacgtagagtagagcttcctcccatcttctgcccaaaccccactgcccatataaaagacaaaaaaatttctattttctttgagccattacatatttaggagtttatttgcttcaacagttagctatcttaactaacacaccacccaacaaaggtacacaatgcagaaatgtctgataaacgaaaaacaaataatgagtgagcctgagtttcaaaagtagaatttcgaacctaagacagtccttcttctagaaagaataactgaaaactagtacaagccagcaggcacagaatagaatgtttgcttcttgtgccctttaaaaattggatttggtttccatgtcatccttatttgaaacagagcgctaatacaaattacttcttcagtgcccttctaggcctaagaatctgataactttcaaacattaagccaaaatccacttggaatgatgctacaatctctttaaaaaaaaaatcagtgttcatattttacaatttgttattctggtttataatatggtatagtagatcaacagaatgaaatagccaatcaaacagaccggaggactccagcctacatccattaagaccattttctcctaactggtctccctggccctggcctctctccacatcaatcctgaccaatttttctaaaacacaaatttggttctttcactcccttcctcaggattccttgctaggaagagaaaaccaaataccacatgttctgacttataagtgggagctaaacattgagcacacatggacatacacatgggaacaacagacactgtggactactagagaggggaggaagggaggagggcatgggttgaaaaactaactattgggtactatgctcactatctgggtacaatatacccatgtaacaaacctgcacatgtgccccctataactaaaataaaagttgaaattttttaaaaaaaatccctacttgctccttatcactcaaaagaataaagttcaacttcttagcatgatattaaaggccctccttgatttgtccccaaatgaccttatctgttgtatctcccatgtggtcaacagctccctactctaagcctctggttccggctctccccacaatcctgctaagtgccgccatacttctgtgccttcatggatcccttggcctcaagagtcactgcctggttgcaacccattctccacctactagaaggcttctcatcctgcaagctctattgcaaatgttacataatcccttagagctttccgtgtcctttcaaagtcagaatatattgtcaattcttataatgctattttaaaattcctaaaattcttgcttgtttggaattaattttaaatccagtgttgttcatttgaagaccataggacaaaatacaaacaatatcctgcacattaaatataggtcagagctatttctctttctcactgagatctattatttttcaaatgttgacatatgaaatcagaagatgtcctaaatttgaaatcttccattttgtcagaccctgacattaacaagaacaatgctgcatggaagacacgtgccatttatgaatactcacccacgagcaggatcaacagttatgccaattggaaagccaactccaagagctgtcccatcattggcaatcaatgtttttctgtatctgatatctccgtggagtgtcaaaacctatagcataaaatcacttattagaactgactttcataaggggaaccaaaggaaactgagatgaaggagaacttatgtacaaaacaaattccaaagcacgattagggatggatgagagaggatttgcatgagattcagataatctatattgcacttcagggaaatgaggaaattagctcaatagaaaatgagagtaagagcagcaaaatcacctcccaagttcctacttccaactcacctaaaatttcaggagggaacatttttatggataaaaggaagattcagttgggaaaacatacagagccactgcctaaagaaactgcaaaaatccttcaggagagctaagagaaatctctggaagacaaatgagaaccccacagctttcctgcaccccaccaaggcactcggtggccagttactgccaacacagttgatcaaaatagtccaaatttactcagaggtacagtgaattctgttccaagtcaacaaactaaactgaaacacatgagctgaaatctctgccctgccaggtcctgactgtacaatctgaggcaaataaattcacctctttgaactttatcagtcaaatatggaaggtctgcgtagaccttacgggactaagagataatacaggtaaagcagcacaccacccagcacaactatgttcaataaacttctattgtttaattggtccatctgttggtcacttactatatatgaggtattagagcaagcattattgtattcgatcctcataaacaattctgtgaggtagatcccattatttttctcaatacagatggagaaaaagaggcctacagaggtttagtggctttcccaaggctgtctgtgattattactgttataatcacagtgttaacagggccctgatacagcacatagaaatatagtttattggactagaaagaagtttcttacagcaatgaagctattttaatacgtacctaagacagtctaacagacaattagtaagaaattagaaaatgtctgttgatttttgcattaaggtttttctataaaattgcttttcaatacaaatagattatttgtgtttctctgtctctcatacatgcgtgtgcacgtgtgtgcacgcattcacacgcacacatacacacacacacacatatatccttctttccctcattcttttctctaaatttttttctctgcctattgtctggtatctttcactcttgcttggactaaggtagcttttcttttctcggtttgcctctttctgctacaatctctctccttttcctaagactaaggatctctttggttcacagttccttttcttgctttctggaatatatagagctctctctcacacggccattctgtaggcttcactacaaaattcagctataaaatttcttttagtggatgggaacacagctacccctagtggataatagtttcttcaatgtttctcttattttcaagttggagttaaacacgaactactcttaggcaggaaggaatattatacaggtaaacagaaagtgaatacgattcctattttcttaattaatccaacaatcacctggaagacttacttacaatttaaatgacctaaggggaaacaccagttaaaccattaaaagggcagtttgcccttggatcattattctcacaggtctttcatggattttctaaaaatattgatcatttgagggaaacagcgctctgtatttacaggatacctcagtgttatgaagtacttttacttcctcagccataaactccactgtacagatgagaaaacaggctcagagaagttaagtaatttgtccaaggtcgaatagctcatgagtggagaaaatgcagtgttgtccccagtcataaaatgcatttccatgtttcagggtctttattcaactgtttttctctcctgggacaccttttccctacgtcttcatttggcagaaataaaaacagtcatccccctcatccatgggggacaaattccaagatcaccaatggatgcctgaaacctcagatagtactgaatgctatatatactatattttttcctacatatacacacctatgacaaagtttaatttataaattagacatggtaagagattaaccataatctgaaaatagaacaattataaaaatatactgtaataacaattatgtgaatgtggtctctctctctctcctcccttttaaatatcttattgtgctgtactcacatattctcaggccactgcaggtaactgaaacctcggaaagtgaaaccctccgataagcaaggatgtattagtcatctttcaagactcagctcacaagtaaccatgaatgggaaatctgcatgctctctcccctcacttatacctctgcctccaatcactagcactttatattcaccggccttatcacacttatgacactggagcacaggtatttgtttatgtatccatctcacagatatgtgagctacttaaagacagaaaaaaaatgtttattcatcttaggatatccaggatcaactgatccatagaaagcatttcctagtgctcattaaatgaatgaataaaatgagcaagcaacccagactcaaagccaggtctttggactccaaatcaaaatatctttcctctgtaccacactgcatcagggcataattagaaacttttggttcatgtggttaaagtggccttaccaatccatacacacatgcacgctcagttattctccaactggccactactgcattgtacctaacactaatgggaaagacacgttccctgcttttggaaaactatcagtttaaaagaagagaaccccatttactaatcaagagacaaagagataaaataagagcatattaattgccatttggaattaagacagctttgcactgggtggactttagagagatgtgagtttggtagtaagggtcttaggcagtagatgttgcctgtttaatgggaggatgatagtcttagttgaaatcatgaaaaatattttctgccactgtcaaagagggttaaaccagtctggattgccggagttgtagtttataaaagtgcaaagagagaatactgctcaggaattagagcagtgaagctgaccatttaagacatcttcttagcttctgtgggccttggtttctgatgtaaaaaaataaaaataaaaaaaagagtttgaaccagaggagcctccaaggggcccttcatgttaacacctgataattctacctggcttgagatacttgtgcacactgcaaatttccctctcatcacaaatggctaccagaactgcctgccctcaggaatgttgtgaggattaaattagatgctagtgaaagatctttgtaaactcaagcgctgttccagtgagagctcttttctctgcctgggacaccttttccctatttcttcatttggcagaaataaaaacagtcatctgcactcatccatgggggatacattccaagatcaccaagggatgcatgaaacctcagatagtaccgaactctacataggctgtgttcttagtctacagagagtgctttttagtatagataggtgctctaaattagccagcaggctgctgtgcgccttgctcatcttcagtatctttctgaatgctccagagaaaaaccgtcttgccagctggtgcccacctaaagcagtggattgtcagggctctgctaactatccccctccaaaaacttctccttgttttgggaagtttcactttcaaaattattgtgaattaataatcccttccatgttttacccttctctcagagtggagcaaaccaacactagtcaagttacctctgacttacttcatgtgatttcatacctgtgcctcatctagaatttcttctgggaattagagtaaaaagaacacttatcttgaagaagagagtatcaaaggaattagaatcaagtttctactttctgttttgctgttagaaaaactgtactggagccatagaaagatttccatctaagaacagaggcaaactataaatttggttgagaactgaaatagcattgaagattagatgaggaaacatagtaaaattctctgcttaccataatcttccctttatgttgaattccttatgcaacttttatttatcttcttatatattattttgtaaattacctaaaacacttttatagcaacaaggtagtattgataattaggaggaaacaaaatagagcaatagaaagctcaaataatttatttttgccagccaggcgtggtggctcatgcctataatcccaacactttgggaggtcaaggcgggtggatcacttgaggtcaggtgttcaagaccagcctggccaacatggtgaaaccccgtctctactaaaaatacaaaaaattaactaggcttggtggtgcacgcctgtaatcccagctactcgggtggctgagacaggagaattgcttgaacccaggagccagaggttgcagtgagccaaggtcttgccactgcactccagcctgggcgacagagtgagactttgtctaaaaaaaaaataaataaataaataaaaataaatttaaaaaaaattttaaggtggttttcctctttcacttcagagactttgatagttaacactaatatcttttccctttttctttttgcttaaaaatgattccaaaatccacgtgagatctattcctgagactagagtttacatcaatctaaatccaatgtttgtgtaagtagtattatggaatcattacctcgattgactgagttctaggattggtagaataaaggtttcttgaaatccaatctaaggccaggttcatagaaggccccaccatagatatagaagcaaatactgtcctgttggtgccatctgtcttcactctgtgaatttcaccctggaaagaaagacaaggggaggtgagcagttccaaggccatggctcctacaaaagaaccctttcttcactgtggctactgccagctgctgtatttcttgaacagtccttacactcagaggaaaggcaaacaaaggttcagcaccactgggtaggcttcaaacgatttttcagtgtgtcacaggaatacacaaggcttaccattcaggctatctccagtactggctacagagatagttcttaactaccacaagcatacaagtcatgagaaaaacccaagtcacagatgtggatcagaagaccaggagtatattttgtatataggtgacaaacatgaaacacaaagatttttcttctcttcctcctttatagtcttcttgctctttccctattcttacaggttttttccctgaaggctgaagaaaatgacctctgaggaagagaactggagaagtgttcattcttaccctagaggcaaatattctaaaggattctaaaggaaggccccagcaccacatcaaatgctttcactaaattcccttagggagctactacttttatcttgagttttgatcatttttatattcgtcgaatattttctactagcttaagactcctctaggggcaagcattgtgactgctgcttcttggcatgtattctgtggttagaagcaggtaattcagtgcagggcaaatcataggcacttctggaaaatacttgctgaatgagtaaataatacacaatagcttaaatttgtttcttattctgaagctaaagagtgttatgatttttgctccaggccaagctcacatatatacccctcattgaatcaaaaaacttagggataaatttatttccacattgtttcccttttactcacatgacaaaagtttgcttataagaaaacatcagtgcaggcaggctcttcaagaataaattatatactttgaatgttattcaaaacttactggattttcaacccaatagatgtattgctcagcatcatcaaattcaacatctaaaccattctgtatccctgctatggggaccatagcatcattgctcttcacctcaggattaagggagattccaaaaattatatgttgccttacagttattaagaaaggttgatcatctgtgaaaatagaagaatatcagtcaaaatcatatcccactattcccagacatttagagtaatggaaggcaatagcctgttaccatcatatgggctaaaatgacattgcagcattgcagcaataaatataatgtacttcatcagacaagcatgggcctttcccagggtttcagtgggctgctggaccacaagacctccaaccccacatacaacgctgtctggactttttcaaggcaggttggtatttatcttactcttcattaagtccttacttacactaataaaccacccatgtttgctaaacctcacagacaggaagttcttccacttctacacacagacaaacctcactcacactgatctcagggaaaggagagttgagttttgaaaaaaaaaaagtgaaaaaaatcattgagactattcttgtgaaaggcagcttactagttttaagaatgttccaaaaataaaacaacactacaaagtgttgcctagtatttattgagactttaataaataaatccaatgtataatcctatcagttgttacttgactagtgtctctcttccctataagattttaactcccaaaggtcaatgactgtgtctgatttgctcattattgtgtcccagggcctggtactcagagcctggcataaaatagttgcccaataaatgtttgataactaaatggatgaccatatgactgcattaatggatgaatgtataagtgaataagtaaacagtatcttccaaagttctcaaaactgtctacacattgtaatttaaacattcccataatatcttaaactatcagttcacttatctccttaatagataataaaagttcctttttcaaaaataatttaatctttatcctgatccccatcaagagtggggttttaaaattcctctctgagaaaaggaaaacttttgaatctaagttttgggttaagatatatgtataagatatatcacatattaagacaaagtatgaaatgattaatcattacacaactttcataagctaaaaatgatgttttcattatttttataatccgggaagctttccatcttcagcaggatgacttggtcattttttctttacttattttcacatctcattagctttttcttgttcctatcatttctattactgagaaataacccagtctttattaacctaggacaaatttaaatttagtctaatgtaaatttcgcaactattaatgctttacatttttcaagtactacaatgtagagtcttccacaacaagcctgcaaagttgttttcagctggagcaaatgagatttgcaggagctctgtgacttctgcaggaaacagtaataggagatggaccctggctcattcacttccaggcccttcttctctcagctgctccacattgcctctcttctgaacaactgcaattgcaataaaaatcgcttctcattgattgagaatatgcgccatactgcatgcatcaggtaagtatttcccttaatttatctccctcaagtttcctaatcttgtttgttagataggtcctccctcaatttgcaaataagacacaaagaaatcaagcaatttaaacgaggtcacacaaccaggactcctggactccaaaatctacgtttttcatcactacactgcaaataccgcaggccaggtactatttcttgagtatcaaattaccactcatttcatttggtttaactgcaacagtaaaaaaaaaaaaaaaaatgctagattatgagtttcagctgtaccaagaaattatattgagatgatatttaattatttattgattatctgttattaatgttcactggctcagtagaaactatctctgtcccagttttatgggggactttaaatttttactcacttacgtaagatctgatcctgcccttttgaatgggtcatctccctttgcttaattggaataattctcaaccaaagcattgtttagggcctaaaaactttgcatatctcatccattatgcatgggccttcttgactcttccatggtgctcttcccttaagcaccacccgcttctactgcttcctggggatcatgtctcaagccctttatctgataactgctgatgtactgagaacgtttaccaccaatgaacatttgcaagcaatggaccagagaacaggatctcctgcaatgctgcgctggctgaaactgtgagcatcatggtgggggatgatgccaggggagtaatagaaaggaactggccagtaagacaacaggtggcgcagggagatgcctgaaaagtgctatatgggaaagcaaaaagaagtgacttcacaacactgcacacatttctacggagcaaacgggtaaaaatcagaggactggggaagtaacaaaaatggatattggagagcttgtcattcactcaacatttactgagtgccaccatgtaccacgaagtgccacaggcaataagcatacatctacagaccaggtagaggctttatcctcaaggaacgcagcatctagagggcaagaccaagtatatgagcccttacaattatgacaatggcatgaaggggtaggcacagaatcatctagggttggatggaaaggaattcaggaggtggtgacggttaagtaggtcagtgtgtctctgtcttttgaagttaaagatcatctcttcatttctattttccatgtcataatcccattaatgttagtgtcagcagagtcatgaagacactatagtcaggaatgagaactcagtgttgtaattgaacgacaatatatatgacccccaaacctaggtcctccttaagtcataccctgcacaagctgatcagcactgcagccttccctggagcaaggacaaggagtgttctcttatcttgcacaaaatcactgaagcaagtgccttgtgcccctgagaccgagtcagaagtctatttgtatttggagtaattttaggggtgctgaggtgatgtttggcttgagttttgtttgttcatttggttttggcattgtggggaatatattttctaaagaatttaaaaagtctcatacagagaaagcactcattataacataaaattagaaataagtagaaccatctcataattcccctatccaactgtaaccactattggcacttgtgtgtttttgcttccagaaacttgtgtgttttttaatgcatgtttttacaaggccaatattgtgcaatatctgcttcttttacttaacagcatcacagaagcacttctacatatattccagcctcttagtaaacactagttgaaaagctattcaacaatcaaatcaagtaaaatgtttccacctataaatgttaacaagttttctaaacttcttgttggggaaaaaaaaatgtggaaaccttttttcatttaacatatattggcaatcagttactcagctggtgctctgaaacctactgggaaatacttaaaaagttccacttcggtaaagtcaacccatgagaaaaccactagtggaattatttgtgaaacaacaaaaggcactatttaaaattaacacttatcaatcatcatcagagagtaatattgattacaccaacccccaatgtgcaattcaacagtctttgtgtgctgaaagaatgctttgtatccgaaatgtctacagcccagtttaatcttctcctgaaagactctaggaacacactaaattaaacaatgtcaacgaggattaggtacataataagtctctgaggaaaaatggcaagtgccagtccctctgtgagaattaccaataattaaaatctttcatcatgaaagtatcattgcacaatattacatgctgatggaatttgattttcagtaagcctacatctgcataatatctaaacactaaaagtttcctgaattcagtatatattttccattctagattaggactaaatttccttctagattaggactctattatctcttaatttaggaatatgtgatcattaaacatttaagttgaacttgtctacagcaattttcatcagtatcaaaatatattcattcagttctcttcactgagaaacgaaagggaacttgggtttagagtaacttcttagatttttaagcaataaggaattatatttttaagtgtattatatacaagtacacactccagaagaaatctcttttgtgaactggatgcaacttttccttcttttcttactcccttaagtacttggtataatcctccacacactcttcaatcgacccaataaaatatctctaggatgagataaatattaaattgctcagtcacttgtaatatctcataccaacacaattctccttcttaaagtatcagatggtaatagtaacagtactgaaattggagtcagaagacccaggctagaacactcattaactattggttataagaataaaaatgagacaatggagccaggtgcagtggtccacgtctgtaatcccagcactttgggaggctaaggcaagtggatggcctgagggcagaacttggagaccagcctgggcaacatggcaaaacccggtctctacaaaaaatacaaaaattagccgggtgtggtggcgtgcacctatagtctcatctactcaggaggctgaggtgggagaatcacaggggcccggaaagtggaggctacagtgagctatgattacgccattgcactacagtctgggcatcagagcaagaccctgtctcagaaagaaaaaaaaaagaaagaaagaaaaaagaaaaaaaaaagagggagaaagagacaatggacataaaaaatgaagctgtacacaaacgttgagaatgtttacttcttaggtgaagaatttggaacttcccattatcatggcttgtcagagaagtctaactgtacccaggtgagagaaaatatgaggttacagattgttcaattacatgcacagataacattagttccatatacagaaactgtattacaaccaaggcacacagtgacatcaccccatacaacacacatcattctgcagacacctgaggaatcaaaggacacagcacatgttcagtcgcaattggttttagagtttccactgcttggcacaaactatgaccagctccatcttcagagctcacataaggagcatactatacctctcaagcaattcaggagatcaggagacagactccatcctgaaggacaaacacaggagtaaaaatgaggcccctgtgaggaaagcaggcagagatggctgcagcgggaaaaggcacatggattcacggctgcatgagaaagagaagaaagcaccagtaagtggaaaacctccacattaaaatcaaaacagagtcatgctcttagtgtccttccagaggccccagtacaggggggcttaagtacgttgttacctctgttgttttcttttgttttgttttcactgaactactcacactttcaacttccctagcatcaggctttcaacttagaattcataagagacacgagagaggagaatgactcaaggttacagatcaatccagtctataactggattacgaacaaacagccactgagtaatctggaacttgtaatagaaatatgatgccaaataatctgtctccttacctgacctaaaagagatctttttgcattaaaaaaaaaaaaagttgtgtgtttgatgtgtgaccttgtagtttacctagagttttccagattttggttagataataatcttttatttttctactgatgatatctctgtgtgtctctgcaccttgaaaatcaggattctgtgtggtccccacacacaggatgtttcctagatcctatacatttttattacacataccatgttattaatagattattaatccattcattcaccagaaaaatggtaggtattcactgtaaaccaaacaccattctaagcactggggacgctataaaagtggagtatatattcgagcaaaaagaaacaactaaactcagagagagagagagaggtttcagaacatgagggtaaagagcaaaagaattatgagggggtggctattttaggtagagcggtcaatgagggcctctctgagaaagtgacatttgggtagaatcctaaatagcacgcgaagcaactcatgcagagatctggaagagagatgttccaggtagagggaagagctagcgcagaagctgagaggcaggagtcgcctgctgtgcttttggaccataatgaaatccaatgtggcaacagcgagtgggagaagagagcagggaaatagcagcagccacatgctgaagggtgtgagaaacaattggagagttttgaggagagaggattaagtgaagattaagtgacttatctccctctcccaccagaaagaacagtacggatgccaagtctttcacctagacacccataccatgcactttaggacaactcgtgctggctacagcagagcacctagaaggcagtggtgccataataaactagtcctaaaagtaagctgctttcaatcagagtggtagcggtaagaggatcgaaggcactatctggtctgtactccatttgtcagctgaggaaacggagactcatgtgagggtcaaagaggtagcagccaaatgctgaaatgatataattcagatgtgctgttattatatcctaggtttgaaatttccatggtaaataaaagtaatggcaatgtcaggactagggaaagtatatagtggggtggtttgtaaagagaaaaggaaaatgtattgtccaaacaaatgggtctgtaacagtgtgcatttagcattcccagggtcagtgtttttcaagctactcccaggcaggatgtttctctgtatcactcacaatttggttgtttcgaaggatgaaccgcaacaatcccaaggggccattgaatattatacattacaactgactggttccctccatgccacttgttggctcgcataacccgacgagtagcacggtcagtccagtacacagagtcttcaaagagagttagggcataggggtgccgtataatctgtgaggcagaagagaacagtgagacctcatccaaaaatcaaagccaaggtgcactgagtcaaagaggatatctgctcaagaagacggtttcctttaacatgtcattatttaataaaaacacaaggaagtcattgtgcaaaagagcggcaaaaaatacacaattcgtcctatatcccactaaaccattcaagagcctttcacatacacgtgccatttactctttatgtttgccttggtaattacactgggcatctattttacaaatgaaaacaaaactgaagcacaaaaagcaaggtgatgtatccggatcacctactagttaaaagttagatggaactagagagcttagagactcctcatctcccactcccacgccccagccttcactccaccatcagcacacttgtgccggctatttccacggtcttgtgctgccactcactgattcacatcaatctgttatagtttagatgcatctttccttcaagtcacagcaactatacaatagcaattttttctcttttttaaattgtttttaattttttattttttattttactttaagttctgggatacatgtgcagaacgtgcaggtttgttacataggtatacatgtgccatggtggtttgctgcacccatcaacccatcatctaggttttaaccctcacatgcattagatatttgtcctaatgctctccctccccttgcccccacccactgacaggccccggtgtgtgatgttcccctccctgtgtccatgtgttctcattgttcaactctcacttatgagtgacaacatgaagtgtttggttttctgttcttgtgttagtttgctgaaaatgatggtttccagcttcatccatatccctgcaaaggacatgaactcattcttttttatggctgcatagtagtccatgatgtatatgtctatcattaatgggcatttgtgttagttccaagtctttgctattgtaaatagtgctgcaataacatatgagtgcatgtgtctttatagtagaatgatttatattcctttgggtatatacccagtaatgggattgctgggtcaaatggtatttctggttctagatccctgaggaattgccacactatcttccacaatggttgaactaatttacactcccaccaacagtgtaaaagcattcctatttttaatgggggtcaataacagctctttgataaaatatctattttctttattttcccatttaacttgtgaaaataaattcaacagaatttatagaataaaaaatgttatgtgaagaacaagactgagaaatataaatctagttaatttttgttttttttttttttgaaaacagggtctcactttgtcacccaggctggagtgcagtggcacaatcacagctcactacagccttgacctccctgggttcaggcaatcctcccacctcagcctcccaagtagttgggactataggcaaacacccccatgcccagctaatttttgtatttttttgtagaaatggggttttgccatgttacccaggctggtcttgaactcctgggctcaagcgatccaccaacctcagcctcccaaagtgctaggattacagatgtgagacaatgtgcctggccaagttaagttataaatttttgcttgaaaaaaattttttttttttttgagatggagtctcactctgtcacctaggctggagtgcagtgaggcaatctcagctcactgcaacctctgcttcccgggttcaagcaattttcctgtctcagcttcccgaatagctgagactataggtgtgtgctaccacactggctaatttttgtgtttttagtagagatgaggtttcaccatgttggccaggctggtctcaaactcctgacctcagatgatccacccacctcggcctcccaaagtgctgggatcacaggcgtgagccaccgcgcccggccacctgacacaatttttaaaggtatagaagcaacagattcacatctgcagctcaactaaatcacacgagctataaaaatccttcctggatatggcacaagctgaccatgaactggaatgaaaatattcattttccagttagtcatatgggatagactgcctctcactgttgctggtatttcctggattgatctgacaatgtctatgacacaaaaattaatttcttagcttttctgatactcgtctgatttctacctatccacgactgtagttttaatttggttttcctcaccaccaacttaccaaatcactggctatcacctgtctccgatggtgtccattataatcacaaaagtccatgtaatcaagataggagtccatgaagtagagcagtctgttggggtagtcaatagttaagccgcagggccagaagatcttgtcctggacaatgacagtgcgcatgctgccgtccatgctggctcgctcgatgcgagggtggtggccccagtcagaccagaacagtagatgctcactgggaaaggaaatgagttaccaattggaggggacgtatttaaatattaaaaataactgtcattttaaataatacaacatcctgtttatgccctgcttaaaataaatcatctctggttcagaatatattcacagagtttattgtttcctctaagtgtcacaaagtaaaactgtcataacacaatcacaacccatctgggtatttttataatgttcataaaacatgtaatacataatgtcataatgtagtacattatgacattgaaatgtctcaatgccaattcatgtttgtttataatccacaaatagttgatctagaaaaatccatctgtccttgtttgtctaccctgtcatgtttttagataaggaaatcaatttattcttcatcaggaattcatcataaatttcagtggtgtgtaatactttacaatatctaggaattcaacatcacattgaacataacttgcctaatttaccatcctgcagaaaagaatctaagttataaaatataagtaaattcagggaaagaaatcctcaaagatttccaaacacatgggagaatttctctatcttcccttcaggatcagcaggcaaaaactgccttccttatatgacttaaaagggagctctaataaacaacataaaactgaagcagaaaaatccagcttttttgttgtataatcatgagttatcaaagttacatcaaactggcccctctatggactattactgcatgcagtaattagaaacttaatttttaattatatgacatttcaaaaattgtattgccaagctaataaatcaatgtgctcttaaaataaagtaaacaatcaattgctcttatgtactttatgaagaggatgattcagatgaaggagagatagcaacacccagttggacacctaccatgtttaaacaagggatcattttaaattttgcatatcagcaacatgcatatcagctacatcatgttactgttgtttttccctcatcataaccatgtcaaggcaacataattttaaaaaaaagtcttacttcattctgggatctaatgctagtcctcttggatttgttaggtttttactaatcagcacagtcctgtggctcccatcaattttggagacttcaattgtttccagagcatagtctgtccagtaaagattacgacctacccaatctattgcaatagtttcagtcaagatgatgctactgtcaaatacctaaagacaaaagtgaataaagagtgaattctagagcaaataaatgaatgcaaacatggatattatataaaaatctagattaaaccatctaacttgtcctataattacttgtggggattagaaaattttgtctcctcatgtagctaaccaccaaatcaacagcagggttttctgagaaaagtatacaagattttgtcacactgaacattctaagatgacttcattgtttggttagtgcatagtttcgttttggtttcaaaagtttttgcaattaagaaaaagctctatccatttgcttagttggcaacattacaaaatgttatagtgtttgcatgcaacgaataatatctctattaattaaggaccaagaattacaaaataaagttgtaagaggcagaggaaatgtaactatcaggagccaagaaactgaaattctgggagatggattgagaaatatcactaaattaaagctaagaaaagcaaccccttaactttcctgcactttcctctgctctcatccacaagaaaagactgcaaaaggaaccgtaaagacattgtgaggtctctgcatcacctgacctggaattcagaatcacacatctgcattcagaggccaccctcctatctaaaacagccataaattcgtagttatgaacacgcaagtctcttgggtatgatgtggcccagaaggtaccatgagagctacccagatgaggtagggccttctctcactggtgaataacagcaaacagacccaagacagaggaactagccaggccaaaggtcaacagaaatgtacttaccactcttctgtccgttccattttgaaacgcactccaggttttaccctgagttgcatcagaccaaaagatacgaccactaattgaatcaaaatcaacagctacaatgtaagaaccattctcgaccaatgaatagatattgtggacctgggaggtgacactgtcggcaataattttgttctgacttgccacaagtaacagcagactctcagatgctgttcaagaaaaaaatgcaaaaatgtcaatgatactgggagaaaacacaaaacaactctttaaaacttttgattcaatacttttggtaacagaaagaaggtgtaattccaaactatagtaagttggtggggaggggaggaagccccatatgaatgattttaatcacttcattcttaaccttaatagttagctggttttcatgagtacttaaaatagactctttcttgggttatatttaactgtgtttctaaatactagtctagagtaaactatgcttacattcttccttttactgtatttatttttgtactttggttatcttccttactatttaataggttgtaggcttctggacagcaggaatcatgtcttaaatatttctgttttctgaggccctcagctatggtagagagttctaattctcccaacaccccctctcttctttttctttttagtaataaagcatgccaagttttagcttggcacagactctccagccagagacatttctctccctccactgaagtttggagtgaccacatgactaagttctgaccaataggatgtgagtagaaattacgaatcaaatctcaggtcacattctaaaaaggaagctgcttgccctccactttctctttccccttcctactttctaagagaagctaaaacctggagcattggaacccttgatgtaagccacatgatgaggataacagagcagaccccatgccctggactctctgacatccagactcctactacatgtaaaagaaagaaactttctgtttttgttttagcttcctctatttggtcactttgaaagtggtcaaatcaatatcctaatacatagtaaaaagcactttcttatagcagaaattgaattaatactggttgaattcaattaagcattatataaagatgcttaaatatagtatagaactcattttaaattatataaaagccatttggtattattttaaatactttaaaaatcattgacttgtatatgttttaacctctattttccaaaatacaccaggattttaatgtgtattaccccatttaatcctcacaaaaaattgaggtttaaagagattgcataatctttccaggattcaagtcgatctaactcctaatcaacattgtcaaatacctacatgtgccatttgattttaagctctgggatgtgctgataaactggctcgggttagttcagcaattacctgtaactttgcaagtcctcccatcactttctaacatgtagcctgtatcacacgagcaccggaaagaacctctcatattgtaacagtgctggctacaagagcctagaatatcacattcatctatgtcttcacaggtcttagaatcattggcaagtaagaatcccaatggacataggcatttagccccaaagggctcttgaacacactcgtgagtacaaccaccattgaaatctgagcagctgttcccatctagaaaaaagaaagagaataatgaaaaaagaaaatcaagaatctttgcttctttgattcactcttatgcaatatttattatgcagtctcatgccaccttcaatatgatgcccagacaagagctaagtgcagcatgcacttgggtgagttccacaggctgttcagggtttgctctaatttgtctgaggatttaccatccttcatatccattggagtatgatcaccttcttcactacaacccaatagtataactccatttaatgcaatgagaacccttgggaaaatattgttgacatcaaggaagaaaagtgtcattgatagagcatgcaaagacacttaaaattgtttctcgttttcttcctctgaaattctactatctatacagaaatggaagatagacaaacatttaagagaaaagaccagaaaatctatgaagtgaacaaatcaaaggggaaaggtcattgaaatattagagtacacagatccggtaacatatcgtcatgccttactttcagggccaaaatgaaaatgcctaaagccaccctaagacagttcacatgcctggggatgcaaatgccttctatttccatgtgtactctaacatatttgtaagagtcataacacagaacatgcgttagaaagggaagtaagttaatataatcaggacattttcagaacaaacacaacacatatgaaatcataagaatctgaaatacttcacaatcatacctggctggggttcatctgagagtgagcattgattaaagaggaaagaaagaaatgacagtaattaggattacatgccaatcacagcactttaatcacagcaacacaaatccctggacttcatttttttgtgataagttctgattgaaattagaaaatattaaagttagaaaaattaatgagcacattaccaacagaaccaaatttaatttgacaatctaatggcctcaatttagtctcattttttgaaacaaagacataaaaagaagtaaaaacacataaccaagtacaaaggatttaatcagaaaattatccaatggtgatgtatttgaattcaattatggttaccccctacacagatgtgaactcatagaggaactgaaatccttcctacaaagctacacagtgactgtgacaatggtgatgcacaccaggctactgttcagaatgagtttatggccagtaaactgtggtcaggaaacttactgcaaagtggggactcatctgtcccattggggcagtcaaagatgccatcacacactacactcagattcacacagatgttatggccaagacactgccattgccaactaggacagcgaaagggctgagtagggcagtccttctcatcactcatatccccgcagtcattgtcccgatcacagagccatgccctgtggatgcagtttccgttgtcacagtggaaatatgatgaagggcaagtcttggggacacaggcattgtgctcatcagatccatagaggcagtctggatgcccatcacattcccagaagttcgggatgcagataccatcttcttggcactgaaattcatctgagtggcacataccaggaggcctggttgctagaaggaaaacatggggtaaatcggcttgtgaatgtaatttgtgatcccttttatagtctagactcagaggaaatgattttggatccaatagtaggtttatagtaacaactatgaccaaattaatatttaaggctaaatgatatagagtcttctcccacactctagtacatagaaatatttctttgtggcagctagtggctctgacaacaaacgaagtacagaacgcacaactgctgactagcagatgagtacctgtgtcaaaagaacatcctgtttccttttcctgtgtttttaatgtacttccaattgcagattcaataataaagtttatctatctttctatgaaagaatcaccagaacattacaatagagcttaaatagctatgattactttgaacttcatgtgtttcatatcatgtttgggtgttattattttccctcagatgaactatacctaatgaaaccatcacacactaactaaagatgatggtaaatactcagttctttgcaaactttccactattcatcaagcaatcctggagagatacgtaagaactgcttccctatttgacaagggtaaaccaaaactctctaccagggatctcacaaggcaacagcaagccagcggcaattgacagtttaacctcagctcatcacagaattttatgtttttaatgtgaaacaggaaaattagtgattagtaatttctagatgttgtgcaaactataaagtatataagcattttatttaacttttctttttaatccatggctttacacactacctttctgacgcaggaggagaattcatgaaaacttacttttttggtctaaaacaccattgttcaaacaaatgatcaactcactgatgagtttttgcaagtctaaaatccatttaaaacaaaaagtgggcaaataacaaatcatgtgagtataggtttccagtctgtgaagattatagatccatcagaattatactgtatgaagtcctacttgaatcctccaactagaagaaatttcttttctctgaacctccatagaattttatctgtgccatttctaagacccttgtaactgtctatcttgcttaattgtctcttgccttctataatctccatagataacatcttagcagatattcaacacataatagcacaaagaatgaattcatcagagtcaatactaaacacagctccataccatttctacaccatgatatgacttctctactgaaacttaaaagaaaccagtaaaatatctttatatggagtagagcctcaaaagtttaaacctactaaagtgggaagtcctaagaaaaactaaaagtgaaaacaaaaatatctaagaaatatttagcccatctaagagactatttgaagtgtccatttatacaaccacttgatttgttaattacacattatatggcaatgtctactcaattttactgtatgttcaataccacattcctttgaggatactttcccccagtttgtctgagttagggaaaatgtgtggcaatatcaatatcaatactggcaaaaatgaaatgacccctttgtctgaaacattctgggtatgtgttacttacgacagcctgcttcatccgagttgtcactgcaatcaaaaacaccatcacaacgatttgtgacgccaatacatttatccccactggcacacttgaattgagaagcagtacagtttaatactaagaatgaaagagaaaagcattagaaattagctcagggctaaaatgactaaacactgagatttttcttttttgttgttatactttaagttctggagtacatatgcagaacatgcaggtttgttacataggtatacacgtgccatggtggtttgctgcacccatcaacccatcatctacattaggtatttctcctaatgccatcccttctctagctccccaccccccaacaggccccggtgtgtgatgttcccctccctgtgtccatgtgttaacactgagatttttctaaataaacattgtgaataaaaaagaaggcaatgcacttaccacaaccaacctcatcagatccatcaacacaatccttgtcaccatcacagacaaacgataggtcaatacatcgatgattggggcaattaaactgactaggttggcatgtctctgtcgaatctaatgtcatccgaaaacaaaaccaacaagtttatttcctgtgcaacaagtaccagagccaaactaaaaatggctaaatagctacagaagttatctcaattgtacatgggttcaaaattcttttgaatcagccacactatcaaagtcagctaagcaaaagaactcaaaactaggataggttttagaattgagaataaaaagattacagggcagagtcagaaactgtgattacaccttggaaaatagaccacattcagaaagtgagcatcatgtgcttggacttggactacatttcatgaatactatgaagtccatgactctagaccaaagccaagcaatggagcccaatcaggcaacaaaaccagcatgacccacatgcctagtagcaacagtgtgtagacagacccccaaaactggatttaaaagtctgaacagaacaattctaaaaaccagggtcctaccttactgttaagaccatagccttggagtcggatgcagtggctggccccacccacaacatgaaattatattaaatacacacttatagggtatgaaagctagaagggatcttaaagctcatctattccaaatgatagtgacttgcctagtcaggcaaccaggactagaacttagcccagggaactttgctccatcttaaactattattgaagacatgaaataaaacaacaagctaaaggaaagcagaactggcaagatggaaaacaggtggataagatcaaaggaaatttaaattttctgtgcctctttattttgatgtctttttgcttgtaccaaatgaaaaagaaacatcaatagccaaaggtctggatatatctatatgacttttagtattgttttaaatatataaatagatagctgagggattttcactttttcaattcctatctgaattgaaatgtttggcatcagaggcagtccttgctttgcttccatagaactcaatatttgtaggtggactctaagaatcccatgtgcaggcacgtgcctttgttcttgtaacctattgacacagagattgacaagtggaatagaagtactaaagagacaatgaaaattgcatgagccttagaggaaagaatgcaaggccatttggttgttgaagtctatttacgaggctgaccaaccaagggaaaccagctcaaaacttactgcagttcttttcatcagatccatccccacaatcattgtctgtgtcacagacccagttctttgagatacactggtgattatcacaggtgtattgggtgtcaaggcaggaagcaggtgcgtgggtggggcagttgtgctcatcactgccatccacacagtcgttgcgtttgtcacagcgccagtgtgcaggaatgcactccccatggccacaggtgaacgccgaagatgaacaggtattatctacaatagtaacaaactggtcatgaagacatttgtttttacagccttttaaatgagttcttgccttataaaggctcagttcaccttttttaatggaggcattgtatataataaggagaaatgttcatcaagtgatgtcatcatcactaacatcattattggctggcatttatttggtatttatcatagaaaaggcatttttctaagttatgcacccacacacatcatataagttctctttaaatcctcacaagaatactataaagtacatataattgtctgcattttacagataaggaaattgagtctttgagagatttaggaacctgcctatgattcacgctctggttggattcactctaaagctcatccttaactttcaagctgttacttcctccaaccacaatttcaaattcagactatagaaagcttgaaaatatgtcatatgaaaagtgcaaatagataaaatattaaggtaaaatgctgtgctcttagaaacaagaagataatacacaaaaagatgaaaatttaaaaaatttcagaaaaatgtacaagtgagcactttactcttgcaaatctgtcactcctctttctctccaaaagaaaggttattattagtattaacttcaccttgatagagatttctgagatttcaactgtcctctatcttttttttaatttgaatgtaatacttttgccttctgcaatagtgtttattaggccccaaactatatagactagattaccgtcaaaagaagaatataaaggttaagaccaccatttcattgttaatttattttactctaacatgggagaaaaggaatataacacatgagattttccaaaggctatgattgcaagtagttattctgtgatactattctctcggttgctaaatgttaggtctactttatttttggtttttgttgttgttgttgtttgtttgcttatttttttgaggcagggcttcactctgttgcacaggctgaagtacacggcacagtcttggctaactgcagcctcaacctccccagctcaaacaactctcccacctcagcctcccaagtacaaatttttgtattttacaaattttgtgaaaatacaaaatacaaattagctgggtgtggtggcatgtgcctgtagtcctagctacttgtaattttgttttttttgtattttgtaattttgtattttgtaatagtcccagctatttgtaattttatatacatatttttttctgagctcatctatttcttttttatttatttattattattatactttaagttttagggtacatgtgcacaatgtgcaggttagttacatatgtatacatgtgccattttatattttttgtagagaccggatttcgtcatgtttcccaggctggtctcaaacttctggacttaagcaatcctcctgtctcggcctccgattacaggcatgagccaccttgcctggtcagatctagtttatttcgatttgactttttgaggagtttgccaagacataatgactgcattggtccaaacagccaatgtcaaggaaaaaaattgttgaagatagtctaaatcaaggccagaaaccatccataacattatgaatgaaatttcttgcttagcttcctaaaagccttcaaagtgcatgttaagaatctgaaattctaaaagatatttttcccatataaatagcccaagcttttatttattttctttaaagcccacctctactctattcatcccaggaaatatcgccagtgcatagctacttactaagtgtgccacatagttgctcatcactgttatcatgacaatcatcgactccatcacagagatagtaattgggcacacatctgccatttttacaggggaaggaaaataagccacactgctctgtgggtggttcattggttgggtccccctcgcatgtcaagtgattggaagccagcctcattccataagggcacccacacactcgctggaaatttggcaccgggaagcagaagtggctgcagtcaccgttaggatgcgtgggttgattacaggcgttagaacctgcaaaagcaaagccccgagggagtcagtcatgtacattttcactaggtaggtcacgggtttgatttgtgaaggaaaacaaacaggacaaaacatttttcagacccaatactaaaaagtagcttcctcttggaaatcaacccgccaaatacaacattccatttaggtatggaaaagtcccaaaatgtgtttttcctgacaacatgtttaaggctagcagcattgaacagagatttcaagtcttacactcttagattatgtgaacgacaagaatataaaactaccaggagctagacctttaagtaataagtacttaaagagaacaggagccactgtaacaaataaataaacccatacaaaaaaataaaaaaaactgggcaatctcactcaccagtctggatgttgacatcatacgatttcaaatgcagtatgtaagcaatgccacttcggataactgtcatttctccaccatctgctttcctgactcgaataatggcacccagtctccagtcagtaaaaaataaatgctctgaaaagaaacatgggtagattagtattttcagtcacagctaacttataaataaatcacttgagaaaatgcaataggcttgaaatgcttcttgcaagtacgatcatctcccccataaatatctgtaatatgtttctctaaccattttccacgacttgttactccctagtaatgctctgtggaagtctgtatgttaataatatcagggttcaggttcaggcaagcacatatggagttttatgatggcatttagtagcaattggatttagttctgcataggtaatagtgaaaataagaattggggaattcttctacagagcattaaatgaggcctcataggtctgcacccgctaaagcactcacctgctgagtgctcttaggcaaatactacgctgtgtgaaggagacagtctgaatcattcctgagatccttcccaggtcaaacagttcatattctatgttttaatgacagcgcttaaattgtaatttttttcccttgacttaaataagaagctgttgagaaggaaaagtacaggtctagcccaaaaaaggaactttcagtgtatgtttgaggatcaataaaaatctcaacacaagtgtggattcacctacaaccacactactaatgttagaatgatgctcacaatggtaagagagaggcgacataagattctaaacaacaaaaatttaatcatgttcactttacactaactattgcagcaggaaaataaacatatatttttaaaagaaagaattgcatcaatgtggattttctctttaatgatagtttaactagaaaaccctaattaatcagaaaatgtttaagatgtcataaattttatttgaccaatttccttatctgtggtctaatcaatgaccaatcagtcattggactccctaaatctttctagagcctggcaatcccagtcccactactaacaaaggcatcctcatatacttaaataagtaaggagttcaataaatcttttagttctgtgtggtgcacaatcaagaagatctagccctttagtaaaaaggtacacaatttctatggtgttgcacaacaaaagaactttccaaaagaaattcacaaaaaacagcaatgttgaggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagagcgaggcattgcctcacctgggaagcgcaaggggtcagggagttccctttccgagtcaaagaaaggggtgacggtcgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagacagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccaggaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagtaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagtcttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctgttccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagaggcacaaaaaacccttcaaaaaatcaatgaatccaggagctggttttttgaaaggatcaacaaaattgatagaccgctagcaagactaataaagaaagaagagagaagaatcaaatagacacaataaaaaatgataaaggggatatcaccaccgatcccacagaaatacaaactaccatcagagaatactacaaacacctcttcgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcaaatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaatgatgagttcatatcctttgtagagacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaacagcaatgttgaaagaaataaataattattgctattttgggaatgttgtgttgtcctcatgggtatgcattcaaatttttttcatactgatgaaaccaaaagatactaaaactacattttctcgaatcccaaaacatcccagcccagagcagagaaaattcaactttttataatgtttctatgtgacagcaaatagcatgtgtctgacatcattagtgaaaagggagtaaatggatggcagcggcgggagggggacgggaggagtatttataattaactcatcaaaaatctcatgagcattttttaaataccacacactcctccacagataaacagacagcaggacaagatatgcaatatacttactaactattcattccacacatacattctatgcatgtgagaaagtctttgatttatagtgagtgtctagtcttttcaagcactgtgttaattattcaaagtaggaggtttcaaccagggacacaactagcatatacacagggcttttggtagacttaaacaaaacatgacccctctaactggagtaatcatggtttgtcaaacagacccaggatagatttcagtgtctcctcaccctcttggcctggcatttttatgcagtgcacaagctatacaaccattcacagagctcctgttttcaagactaagcaaaccacctgtttcatggtaccaggctacattcttattcccagaaactcaactcacagcagcatgcctgcactcaaatggggagctgagaagacaggcaagcactggctgtgctcattgtgactgtagttccccagaattcatgcttctcagcaatcttcactagtagcatgaaattatttggaaaggttgacgaaaaaaaattatgtcttgctgttcttcataaagcataacctaacacttccataaaacaaagacgatgtcagttctccaacattttgaataaaaaagtttcaaagtcattcagtcagcatatagttgatgaatatgtgtaatcgttttttccacaaggatttctaatgagattcttacaaacactggagaataatgaaatgctacaatgattactataaacagctcttgctgttttattcttgaaaatgaaggcagtaatttactgtttcctcacgtgatacttgtataactaagtacttgggatgttgaattgtataatacatgtaatctacaaagtgctgtacccatatacactgtcaacattatacgaatatatacaaaacaaaaatcacactctaaaaatgaaatacaccatcaacaaaccaaatgttttgtctaaatatatagcaccattttaaattttttcattttaaagtggccagcttttctgggattgtgaaaatgccacatgaggatgagtttactattgtaacttgcaatgtataaaaacaatacatacttttattgctttaaaacatacctccaaagatggcaagtccaaacggatgtgtcatctgctctatatggcccagtcttcttctgtctaaaccatcaaaggtgctgtgctcaattttatcaaaataggcatctacccagtacaatcgtgaagcactaaaataataaaatatttagttatctcttatccaaaaactatcagagcaccctttacacaaagggcatccaaaaacagtagggtcagttgacacatttattaaacaaagtttttaaaatttaaattatattcattaaaaatttaacagttttatgtcccccagaaagagacggctacttttcatgaagtggctttcaatcaattgtcttagaaaacttaaaatgttgctatctttgagccagaaattttattttctccttgtgaaatcaacaagttaagaaaaacagtggtagtaatctatgtttaaaaggtgaaatatatttcttccctttttttctcccataagttaccttggcatttcatctttataagcttatttactctattccttttcctatattcctagatagatcatcaatttcttgagaaccatagcttatacttttaaagtcctcccaaagtgcatgtaagcaaaggtgcatttgttgattaattgactccaaagatttcctaaactcaagatgttccctgtaagaaattacacactgcctacagttcaacaaatctgtaccctactttaaatgctgcttgggacccacctcccccatcttgagtttccactaaatcttgtcattcagctttctctagcaattttctcagaatactcatgaatttattagttttcaccccagcagtagctggccaactatgtttatgtcctttgtgttcttgttcaatatccttctcccatcaccaattaattatttaaaattccgcgagggcaagcagtaccagtttccttacaccatcatatcacccaacctgcctcattatgtgttctgcagtaaaagagaactaagtatcggggatgatgattcctacttacgcccaatcgatggccaagccattgggccatccaagagtagtgtttattacaggcaagaggtgagatccgtcactccatgctctcataattttagcaggacggaaccaatcagtgaagaatagatacctagaaaaagcagtagtaaattaaggctgttaacactgggacaaactacatgacttccagagatttagaacaaacagagattctccagatactgcaattaattttgttttctttatatgctattgaacttaacatacttagtgtataactcatgtaattctcagttaaaatttagttaacatgtaaccaaagtcacaaatacaaatggcatttaaatgggcattgagagaagagaaccactgtctcagagtttaggaactaaaactattgtcgcctaacatattctctaacaagacacaattcaggttacctattaaatattccacgttattaaaataaaataataaacaacgaacagagcaagaaaacatttcaatctctttctctctagattaaacattcaggatcctctagtcattcttccataaggaattgataaatttgcaggaaaccattcatctcagatgaagaaagcatccaaatcaatgcaatgcaaacagtatctgacccaagcatttttttaatattctaaagagtgggaaaaagataagtctagaggcaaaaaaaaacaaaaacaaaaaaaaaaaacacaaaaaaaacaaaagaaaataaaaaaacaactttttctcttttatgggatccagaggaatcaaaattattcttttccaaaatgtaactttctgaaatgtaactacttcatatcattttaaacaaaagagtcatcaggaaaggaattcaacagtttttcaaaaccaaaggccaaaagtttgagttaagacaaattcattaaaaaactaaactgtttaactctctatagggcaatgaaatttcttatcaataataacatcagttttaaaatgtgtttcttttattatcttacagagaggaaattaaagcagatactctagatgcagcaaacagacttttttaggcacacaggcattccagtcagacaggtctggaatttgaatactgactgttgcctaatagctgcgggccctttcacaagtcactttatctcactgcgccttagattcattctctctaaaatgggtatttacacatacctccttcacaaactagctttggaagctgatgagattatatatctaacggaagaacaggtatggatgttccctgggtaatcaggcattggtgggttagcagccatcttttttatcattccactcatatacaacacatagctcagatttgttctaaataaacacagtagctgttaaacatatttaaataagaaaagtaggaaccaaaaaggaatactgtgaactcttctgtctttccttgtctggcaccaccaattatagaatggtaaaacatgaaactttgtggtctgaaaaactttttattctgaaaactactgaatgattaagcaagttttgctaagctttatataaatatattaaagcagggaaagaatttgggtctttcctgttaattctgttgcctattcactccttttctactgaatctatatcacattgtttggtcctctgcaactgtgaaaaaaactactcttcagtgaagactgagaaagccaaaagttagaagaaatgttttgggtttaaaaacaattttttttactcccccagaataaagttttttggaggaaaaaagaaataaaatttaaggtgatttcaacttatacagttcaatcttatatttgctgaacttacctaaatccctagggcatcacttttcaatgactgtaaaagacatacagtttcaagctcttaggaaaacatgaacacacttacccggcaaaaggatgaactaccaccgaccgtgggttatttaaatactgaactactgtgcgtctcgttttatcagctagcctcatgacactgatactcttgtaatgagagtctgtccaatagagattctttgaaatccaatcaaaagccaaactttcaacattttccaccctgttagctgcgagaatttctcttcctataagttaaaatatggacatattttaagctaagtatattttgtaaggcatcaattttcctactaatgcacactgaaattttgtgtcagagttagagcatatttcaggaacacatgtggaattctttaaaaaaaaaaaaaaaaaaaaactctgtaagctgctgagcaataacatgagacaaacctagaatctatccattcctcaaactttggatctcaaagagtagatatgatactgacaaacagaaccaggaatggtatggcctggatttactcccatgtccaaccttccagaaaaaaatttctcactgtagaatatctgaagaagagatacctgagttcacctactaccacccggagacggctctgataagctgacaccaccaggtacgacctgagggtaaccctgaggtatcatcgcccaaccctctcatcaacagtcttccacagccacaaagttgccaagttttgaaaacaccagcagagataccagaaaggaaatcagaactgattaaaaacaacaacaacaaaaaaaaaaaaacgctttcctctttatggagttattatgctttcttttaccctcttttttctttttttcactaaagaaaatctgaatcagaataaacagccatacctctttcttttgcagtaggaagaaaaaatcctactactttttctcttcatttattcagcaaattgtgaaaagaaagttctctatgtgatagaaagccaactatatatttagaaaacacaatattgttagtagtgttaataatcacagcttagattaaatgagcacttactaggtggcagaaactggaccaagtattctacatggattcatccatcctcacagccactcaatcaagtaggcattagtatcgttcctattctacagatgagagaaccaagtcaaagagaagttaagcatctggaaagaagtgtggacaccaccctcaaggtaattcatagtgaggtggtgaaagaggaggaggcaactaggccaagagacaaaaataaaagagtaatgagtgctgagatggagagatgcataggatggtctgagagcacagattcctaatgggccacatggcaaagcagaggtctggggtggttgacagacacagagactgaaaactctacatgttctaggagtgtggctggaggttaatgagttaatgatagaggctaaaagagagggagatgttcatgatgaccaccaggtggggatggggcaccaaggaaggggtgagtggtcatgcccttcctctaaggcctgtgagaagttggatgaagcatccacttagacatgttggtttagaggtgattgtaggatatccaggtgacgtatccaaaaggcagctggcactatgggtctgaacctcagagagagaacttgcatagagatttttatcatgacctacagaaaggcttgcttggtctttccctcattccccagtttaggaggaaaaacactcagtaaatgcactattataaaagtctccccataattatttatagttgctacatagatagtaatcaaaggcaggaaaggtgtgaaattattcagagagaggaggaccaatgttgaacaacagatttacagttttttatagaacaggagaaaaagaaaagatctccagggtacactagaaaaaaaaaaatgatcaagaaatagaaggaaatccaggagtatgctgtcatggaagaaagaatatttgagagaagatggctgaagtaccaaatacaggactgataggcattatttaatttagcaagaaagggattagaggtgaccaggatgagaggggtgtcagccacctggtgggcagattgcaagaggtgagtaatcagtgagaaatgtggaagaagggataggaaagtgcaaaacaacctttcaagaaacttgaccatgaaatgcagagaaggggttatcactaaagaggaacatggagtgaagggtaagttgcatattttttaggatgggagaaacttgagcatatctgatgatagggaaaagtcagtagaaaaagagaatttggaaaaaagaaggtatcattgaaggagggagttctcctgagggcttcattcagctaatcctgacttttaatatgatttctttttctttttctttagagacaggtcttacctaggctggagtgcagtggcacagtcatagcccactgcagcctcaaacacctgacctcaagtgatcctcccaagtatctggcactacaccacaccaccacattagctaatttgatttctgacaactcatttcctgcatatactgtgtactcattcaaaaaaaaaaaaaagaacaatgtaatgcctccctcaacaaagcatacagagtttaaccactgactatgaggaatattttaaaaggtaggttgccaaaaagagtccaggaccagatggattcacagccgaattctaccagaggtacaaggaggaactggtaccattccttctgaaatgattccaatcaatagaaaaagagggaatcctccctaactcattttatgaggccagcatcatcctgataccaaagccaggcagagacacaaccaaaacagagcattttagaccaatatccttgatgaacattgatgcaaagatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaagtcaacaacccttcatgctaaaaactctcaataaactaggtattgatggggcatatctcaaaataataagagctatctatgacaaacccacagccaatatcatactgaatgggcaaaaactggaagcattccctttgaaaactggcacaagacagggatgccctctctcaccactcctattcaacatagtgttggaaattctggccaggccaattaggcaggagaaggaaataaagggtattcaattaggaaaagaggaagtcaaattgtccctgtttgcagacgacatgatggtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagctcatatggaaccaaaaaagagcccgcatcgccaagtcaatcctaagccaaaagaacaaagctggaggcatcacactacctgacttcaaactatcctacaaggctatagtaagcaaaacagcatggtactggtaccaaaacacagatatagaccaatggaacagaacagagccctcagaaataacgccgtatatctacaactatctgatctttgacaaacctgagaaaaaaagcaatggggaaaggattccctatttaataaatggtgctgggaaaactggctagccatatgtagaaagctgaaactggatcccttccttacaccttatacaaatatcaattcaagatggcttaaagacttaaatattagacctaaaaccataaaaaccctagaagaaaacctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcacagtgaacaggcaacccacaaaatgggagaaaatattcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagacataccatttgacccagccatcgcattactgggtatatacccagaggactataaatcatgctgctataaagacacatgcacacgtatgtttattgcggcactattcacaatagcaaagacttggaaccaacccaaatgtccaacaatgatagactggattaagaaaatgtggcacatatatgccatggaatactatgcagccataaaaaatgatgagttcatgtcctttgtagggacatggatgaaattggaaatcatcattctcagcaaactatcacaagaacaaaaaaccaaacactgcatattctcactcataggtgggaattgaacaatgagaacacatggacacaggaaggggaacatcacactctggggactgttgtggggtggcgcgggaggagggatagcattgggagatataactaatgctagatgacgagttagtgggtgcagcgcaccagcatggcacatgtatacatatgtaactaacctgcacattgtacacatgtaccctaaaacttaaagtataataataaataaataaataaaaataaaaaaattaaaaaaaggtaggttgctcagcatacgaacttgaagtttaccaaaaatactatgagaattccagatcaacaaaacagaaggaagctgacctgtggaggtgcctgtgggagacttggcctgcatgcagctagaaacccaatactaccttttcctgagaactaagctcgactgcagtgctccaagctcagtgggcctgattctaagtcctcaaaaaagataatttctcattcaaaatagcagattgacaaaccaaacatgtttatctcctcttcctccgaaattctacttaaaagacagtaaaataacagcagatgagtaattccaacaaatgtttgaaaagtaaggtattggaggagtgataactcagttaagaaggggaaaatgctacaaactaagtgtcaacagaagagagacacacccacatatgcagaagcctcagtgcactcacactcagaggcaccaggtcctaacaaaggcaggggcgaggaactaaggggctcagataaagcaagataaggagcaatccaatgcctaggtccctcccagatcctgagtgtcacgccactcctctatctcctctaagggaccacagattttctctggaggagctgaagcagaatggctatgggttcaaggcacagtcctcaacacagaactgagatggatgtggaactgagtacaggaggattataggaatactgaaagggcgccctcagctccctttcctctgcccactcccagaacagaccaccatctccccacatcttccccttaccccaagaaggagaatgaaggcatctatgaaggagaaattaatcacccccagaacagaccaccatcttcccacatcttccccttactccaagaaggagaatgaaggcatctatggaggagaaattaatcacccccagaacagaccaccatctccccacatcttccccttacctcatgaaggaaaatggaggcatctatgaaggagaaattgaccatctccagaaaagactcactaatgttgccttggggagcaatctggcaaccaagccaccttcctgcctgaagctcaccagctgacaaggcctatccacatgtacagacttttgggtcaggttttataacctcacccttaataccaaactagcaactcagacacttggaaaaagcttccatcaaaaagaagaaagttgaaaagaaatcaaaaggaaaaggaatccagagaaaatggaaacagaggaagattaatttttaatgtcatatccatatccatatcaaagtcatatccatagaaatggtactcagaatggcactggactcaacactagatattagacgtcactagagcaatgtcttcaaattccaggtttaaattaacttgcaacctgtacccagccaaacagtcaagatggagagcaaaataaaacactcacagacattcaaagactcaaaatatatgccacctacttatgtttctcaggaagctatcatgtaacttgtttcagcaaaatgaggaaataaatctagaaaaagaaataaatggcctgccacaaacagaagttccagcacaggggagtggcaaagagaagtctgtgcaccaggccagagaaaaacaagtcccaattggaacacaggataggggtctccagaaagaaaaaaaaaattatagattgttttctgtctttgtacaggcatttgatagagctattagagcatttggggaaaatacatgattgttatatttaaaaactaagcaaatgaaaatggggcaattgtcaaaaattgtcaagaaatgtcatcctagaatactaattggctgagcagtgaacaatatttatatttatattatgttaataatataaacacatatgattaatttaaccaaaaattataatctagctttttaaggagaatggggggagggaagtcagaagctgggagagaagaatgatgtaagaaagcaaaacgctcacctagaacaaggaagtaaatatcaaaaatgataaatcaagaaatagaagtataaacaaagcatttagaaacatggagacaaacaaaagaagaaatagtcaaaagagctgttccctccccagagcaggtctggattaggggcaggggagggtgggcaatatggttttatattgataacagataaaatgatatccaacatttactgaatatttactattttctagccattactctaggtgtttacatgcattagccaaaaattctctcaacaaccttatgagcaatatatgaaccgcatatttttcagactagaaaattgaggcaaaaggaaattgagtaacttccccaaagttacaaagctaggaaatgtgggaagctggaatttggaaccaggcagtgtagctcctaagctggctctcttagttggtatgttatattgcttacaaattttattactattacaaaccaaacccttggcatttacatagtccagcatccctgaagagatgtcttcccctttaatcaatctggctgcttgagtatgaaaaacagtgtctagtcaattaatctgttaatggctctcatacacgtgacatttcttttatgttaacattggtcattgttaaaatacacacacgtttgtaaccttttttttttttttttttttccgagatagggttgcactctgttgcccaagctggagtgcagtggtatggtcatagctcactgcaacctggatctcctgggctcaaacaatccttccattgcagcctcccaagtagtggggactacaggtacatgccaccacatctggctaatttttttctttttttggtacaagtggaatctcactatgttgctcaggctggtctcaaactcccggcctcaagcaatcctcccgtctcggttcccaaaaataacgtgtttctaaaataaaggaaaggtgtttgttttaccttaatccataaaaaagcaataaatttattttctcaatctaaaactatttaggaagcttagtaaaatctctgcttacataactatccaccccaaatcaacagagtatacattcctctcagcaccacatcgcacttattccaaaattgaccacatagttggaagtaaagcactcctcagcaaatgtaaaagaacagaaattataacaaactgtctctcagaccacaaggcaatcaaattagaactcaggatccagaaactcactcaaaaccactcaactacacggaaactgaacaacgtgctcctgaatgactactgggtaagcaacgaaatgaaggcagaaataaagacgttctgtgaaaccaatgagaccaaagacacaacacaccagaatctctgggacacatttgaagtagggtgtagaaggaaatttatagcactaaatgcccacaggagaaagcagtagagatctaaaactgacaccctaacatcacaattaaaagaactagagaagcgagagcaaacacattcaaaagctaacggaaggcaagaaataactaagatcatagcagaactgaaggagatagagacacaaaaaacccttcaaaaaatcaatgaatccaggagctggttttttgaaaaaatgaacaaaattgatagaccgctagcaagactaataaagaagaaaagagagaagaatcaactagacacaataaaaaatgataaaggggatatcaccacccatcccaaagaaatacaaactaccatcagagaatactgtaaatacctctatgcaaataaactagaaaatctagaagaaatagataaattcctggacacatacaccctcccaagactaaaccaggaagaagctgaatccctgaatagtccaataacaggttctgaaattgaggcaataattaatagcctaccaacccaaaaaatgtccaggaccagacggattcacagccgaattctaccagaggtacaaagaggagctggttccattccttctgaaactattccaatcaaagcaaaaagagggaatcatccctaattcattttatgaggccaacatcattctgataccaaagcctggcagagacacaacaaaaaaagagaattttagaccaatatccctgatgaacattgatgcaaaaatcctcaataaaatactggcaaaccgaatccaggatcacatcaaaaagcttatccaccatgatcaagtgggcttcatccctgtgatgcaatgctggttcagcatacacaaatcaataaacgtaatccagcatataaacagaaccaaagacaaaaaccacatgattatctcaatagatgcagaaaaggcctttgacaaaattcaacagcccttcatgctaaatcaataaactaggtattgatgggatgtatctcaaaataataagagctatttatgacaaacccacagccaatatcatactgaatggacaaaaactggaagcattccctttgaaaactggcacaaggcagggatgccctctctcgccactcctactcagcatagtgttggaagttctggccagggcaattagtcaggagaaggaaataaagggtattcaattaggaaaagaggaagtcaaattgtccctgtttgcagatgatatgactgtatatttagaaaaccccatcatctcagcccaatatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcagcaaaataaaagaggacacaaacaaatggaagaacaatccatgctcatggataggaagaatcaatattgtgaaaatggccatactgcccaaggtgatttatagattcaatgccatccccatcaagctaccaatgactttcttcacagaattggaaaaaactactttaaagttcatatggaaccaaaaaagagcctgcattgccaagacaatcctaagccaaaagaacaaagctgaaggcatcacactacctgacttcaagctatactacaaggctacagtaaccaaaacagcatggtactggtaccaaaacagagatatagaccaatggaacagaatagagtcctcagaaatgatatcacacatctacaaccatctgatctttgacaaacctgacaaaaacaagaaatggggaaaggattccctatttaataaatggtactgggaaaactggctagccatatttagaaagctgaaactggatcccttccttacaccttatacaaaaatcaattcaagatggattaaagatttaaatgttagacctaaagccataagaacccttagaagaaaacctagacaataccattcaggccataggtgtgggcaaggacttcatgactgcaacaccaaaagcaatggcaacaaaagccaaaattgacaaatgggatctaattagactaaagagcttctgcacagcaaaacaaactaccatcagagtgaacaggcaacctacagaataggagaaaatttttacaatctacccatcttacaaagggctaatatccagaatctacaaagaacttaaacaaatttacaagaaaaaatcaaacaaccccatcaaaaagtgggtgaaggatatgaacagacacttctcaaaaaaagacatttatggaggcaacagacacaagaaaaaatgctcatcatcactagccatcagagaaatgcaaatcaaaatcacaatgagataccatctcacaccagttagaatggcgatcattaaaaagtcaggaaacaacaggtgctggagaggatgtggagatataggaacacttttacactgttggagggactgtaaactagttcaaccattgtggaagacagtgtggagattcctcagggatctagaactagaaataacatttgacccagccatcccattactgggcatatacccaaaggattataaatcatgctgctataaagacacatgctcacgtatgtttattgcggcactattcacaacagcaaaaacttggaaccaacccaaatgttcatcaatgatagactggattaagaaaatgtgttacatatgcaccatggaatactatgcagccataaaaaaggatgagttcatgttctttacagggacatggatgaaattggaaatcatcattctcagcaaactattgcaaggacagaaaaccaaacaccacatgttctcactcacaggtgggaattgaacaatgagcacacatggacacaggatggggaacatcacacgccagggcctgtcgtggggtggggggagggggagggatagcattaggagatatacctaacataaatgacgagttaacgggtgcagcacaccaacatggcacatgtatacatatgtaacaaacctgcacgttgtgcacatgtaccctagaacttaaagtaaaatagtataaataaataaataaataaataaataaataaataagactgcttaaaaattagatactgagttttaattatcaagttgtaagtatcattacaataaacaggcaaaacacgcatacacacacacacacacacacaaacctttctcacctgtgccatcaatcttttgcttaaaaatcatgtgttttgacatatctgaaaaaaagatagtgctgtcctgggcgtcaaaatcaatcccgacaaagaaagaaggattccccgaaactggaaccatgacatcttcctgggtagacaaggtgaacgggatcccacgaatagcaacttgggatgaaaaaatgaggaaattctgaacagctgtaggaagaataacacagcacagtcagtcacagcatggttcttttctctcctcccaaattccagataaatgcatccacagagcaaactttaaattataaaatataattctgaaataaatgtaaaaataaatttttggaaagcatagttagaaataatacagggaagaaaaaaagataagcaactatgagggagatacaagtattagaatcttccttcttcctaagaaatgtatccttaaaatgtatttatatgaaaaatgatatccatatgcttaatttataaaataggagatacatctaatgtaatgacgagttaacgggtgcagcacaccaacatggcacatgtatacatatgtaacaaacctgcacattgtgcacatgtaccctagaacttaaagtaaaatagtataaataaataaaataaaaaggactgcttaaaaattagatactgagttttaattatcaagttataagtatcattacaataaacaggcaaaacatgcacacacacacacacacacacacacacacacacacacacacacagaaacctttctcacctgtgccatcaatcttttgtttaaaaatcatacagagctgaactctatagtaattccgtaacaatcctcaagttggtttaacttctgcatagagatctacaccaagaaccttacagtagataccaagataattaacagcaatcagaaatataaagatataaaggagtgaaagcagggaaggaaggggagggataaaggaaataggtaagaagaagtgatgtttaacagcaaagaggagactgtgacaggatgccagggagtcaagaagatgaaggaggtatgcccaagacaaagataaaaatcgcagtaacggaatttaaaagcaaaattattagacaacgcactattgatataatagttagaaatacatgttgtttttaatgagggtgatttttctgaatctaaaactacctaagaagttaacaaatgtgtctgggttagaataagataatttatatacgacgctagaaaccgcaacatctggagagcaagaatttgtcacaggcacagaaaggagaaatgtagaagtgaaaataagaaaaacaaatattgtaggagtgcatttcatcattagctggggcccaggcgatggcttaagtgtgaatagatgtgtaggaaaccaaagaggaagaaaggaaaccttcaaggtaagaatgaaatcaggaatatggaggcagatacaagaaagtttgaactgaaaggtgaaaaactgtgtgagtaactgagccaccccaatgctcaggagtttactttggaatacagagagaaaaaataagccagataagattcagatgtgattacctggttgaaaggggcatacgtggtggtctaggagaagtcaaagtggggagaagtacagtacttcccatcaaagttaaggctaacatctaaagtggaaaaggtatacatagcatagaaaagagctcaaagttcaaccatatggaatttcaagatcatagttaataggagaaaaaggcttcaggaaacaaagggggaagggaacccaagaaaaccttagatgtgggattaaagcaaaatcccaaaagacagaaatttacattttcaaacatagttctgtgtatagtagaagtggtgcctaccaaggaagatgccctgtgggctacagaaagcttatttgcagtcaagaagttagacagggagctggtccagttcaagagtagcagttagtctagttagaggtttggacacacatacacctgtgtcacctgccaacaacgtccaaaacagacttcttaccaatgcagtggcgctcatctgtatccagttggaagccgaatgtgcacttgcaacggaaacccaaaccatcattatctgttctgtggctgaggacacagacctgctcacagcccccattgttatctttacacggattggtagctggaaggaaaaatgcacagggttaaattgcaattagaaatgtgtaattatccaagacatgaagccacttctagcccttttcacctataggtgaaatagagtaatggattagcaacgtgttgaaaacattactactggttactactggatacatccacatctggctacactaaccctcccaatttcactgctgctctcccatccactctccaacagacggtggcaaaaaaaaagaaaggactcctacaactttctccccaataattatgtcagagtatgtctgctatcctccatgattagaaataattgtcaaaagaaaacccacacttcactgcttttttgccatttgtaggatataataaatattactcactggatgcttactttgtaagtaaaccaacttaaccaatagctctaagaggtaagtattagtcctccaattttacagaggagaaaccaagaatctaaacagttaaataacttgcccaacattattcagcagctaaacagcttgactaggattcaaagccagatctgattccaaaaccttaaatgtctgcaacacaaaccagtttatacttccaaaagccactctcaaagtagtgaccttaggaagagcactgccacagctagaaattttatatctgctttcaaaattgtctttttagcctttgacttattctttaaaatattctctttatcttctcaggtggattgatttggggaaacaataggcagatgtcattctgagccaaataatgaaaatagtaatttgagtgatcacattgatcattgatctaatggatctaatgtgagggcaggtgtgagtttagttgtgaattgagtgtaaaaactattcaaaacagatatttccaaaaatgttttcagataaaatatctatttttagacaagtttatactttcccaggatgatgacattgaaggagattcatctgaatgtgtcatttctagtggttgggcttttgttaagttaacctcattactttgcagtctttcttcatcctaaatagatccatcacttaacatgagttttagagcaaatctgttttcctctaaattattgctcaccaatattaagctttctaccaacgtagtgtagtttatgtttctttttctttgatccacaagcaaatacagaaaagagctatatacagtcctgatagacttatcaaagctcaagctataacctggaaacataaacaaagcttatgataggccaggtgcagtggcttacacctgtaatcccaacactttgggaagccggggcaggaggatcgcttgaagcccggagttccagaaaagtctggccaacatagtggaaatcccatctcagaaaaaataaaaagaaaaaatcacgtggtaaaataacaggagaagactaagcagtgtctgaatcaaaatatttctttttttaaaataagtgaccagccagagagacaccaaacccagttggcctatgacagattaatcagaaccaaagaacaggtgccatacatatgcaacagagaagaagaaaaaaatggctctgatgctaccgaaaatggacacttagacatgtcattttcttctatgggacctgtttccttaactgtaatattagaagtttgaaatagatgtctttcccagtagaatgaggataggtattttggtttggtttgtgagctgctatacccccaagcatctttgcaggtgctaataaacatctgttaaataaatctctaaattccctctagatttggcatttaactgtgaaatacatcagtttcttcagaatgctcctaacctgcagaaccagtttcagagagtttaacactctgggtaacccttcatatacttgagaatgccacccaaatcacataagacccctcattattaactttcaaagctttgagaaaacctttccaccaagtccggtaccaagcatggttaccactgctctgaggcttaccatagggctgtctgagggaatggtaaacagtcactccatagggcctcagggaagcctggtagtacacttgtgggttggtctctgtgaacttgtttgccttcagcacggccatctttgtccaatctgtaaagaacacctgaccttcaaataagcttactccaaagggatgaggaatgagggagcctccatgaactacagtcttcctgttataaaagacacatatatatcatacaatttgttagttttgctttattataattaaagctgtagttagttcaattaaatgcctgaaaagctaaataatttcttgtcacaaatacggaatagatagaaaagatacattttagatgtatacatatttccatctacatatgatagaaggattttcatgttgtctcttggaaaagacccttgagacttacattccagtcccagtcaatcctttagcttgtcctagacttttttggaatttactgtttccccttttgttcttcattccttttaggttgccccacatctaaaaggctaagatgtgaaatagcattttgaataccataagtgaaagagtataccaagactttggaagtctgggaaaagatgcctttgccaactatttcccactgcaccattgagcatttcctagcaattagggagcaggacagtgagtggtagggttcaagccccagcaaacgcccacatctgttcctgatgtcactgtaaggaaagcaagaagcaatgccactaccactcttatgcatctgcttgatggaactatcaactgatcatacttgtaatggaggcccaaagccacttaactgggaagaaaacagaagtaaaattaggcactaagcgaagagaggaaatcaacaacgccccccgtgactatgtctccataaacaatgattcagttagactcatgaacagagtgaggcagaggacggttgatatgggaaaactcttattttctttattttggcgtaatacaaagacctcaaagaaaaatcttagcatcccctgaaaactaaaaaggacaatagagctctaagaaaagacttgaagatattaaagctgggaaacacactaaaggggagtaaacaaagaaacctaaggtggcaggttagtgcacactttgaaacattctataatgacatggtacattaagattagagaatagtttctctctcagttagcaaattccaaaaccctgaatgccacctgctggcaaagcgagaggcaatgactttatgatttcagctgtacttgtgagctttaatatttctttgatgtttcttcacagccagcaaaccactcaaatctttttgaaattccattgatttttatcttttatgctttacttttttttacttcagcaaaagttagactatataatataatgctaaaacatcccaaagagaaaaaatttaagcaatttcacaattattttatgtgacttattgggttagctaattttttcataaaatttattcatattctccttatggaagccagtttcagtgataggaagtcaccatattaatacacaatacttcatttaaccaagcagagattgtcccaaggatatataatccaatggcaaactgtgatattatccttacaaaatggaaatacaagaggaaacaaaactataatattgctttcattgagaaaacaataaaatcaagtcattgggaaaaattaagttaaccagcctatttgctgaatccacaaagaataatattttgggtcaaaatttgaagaacatgttttacccaatttttgaaaataccaaaaggagaggatctaaaataattttttttacattaagttgtagttagctctaatcagagtaaaaagatgaaaaaaaatatgccatattcagccaggtgtagtggctcacatctgtaatcccaatactttgggaggctgaggcaggcgaataacttgaggttaggagtttgggaccagcctgggaaacacggtgaaattttatctctactaaaaatacaaaaattgccaggcatggtggtgtatgcttgtaatcctagctactggggaggttgaagcaggagaatcacttgaacttgggaggtggagtttgcagtgaaccgagattgcatcactgcacttcagcctgggtgacagagtgagactccatctcaaaaaaaaaaaaaaaaaaagaaagccatattctacattcaaatattgctgtttaagtatctttgtataccaggtaaaaatacaatacaaagaatttctccttgaaatttgaaatatataagagcagagtaaaatccaattaattcccagtaggcaacatcaaatacctaataaaacatgtatttattgggggaaggttagaaaattaaaagggaaagtgatcttgagaaacaaagcacaaatgaactcaggagtgaatgaaaataatgtgcatcatgtgggactaggggaagagttggagaggagaaatcaaagaacaaatgctggaggttatatttaatgagcgtttacctcttgtgttatgggacacaagaaaagttaacaaaatagagcaggtcacttcatgcaaatgtcagtacaaaggtcattaaagctatcatgtccaccaacaaagcaatattttaattctggtcctttgatatttctctgcagccattttatgcactttccctgcaacttataaagccataagccataaaaaatacttcttacctttgaattccatcataagttacagtttcaatgtaatcaaaccgagagtcaacccagtaaacacgcttcgatatcatatccagagttaccccagcaggccatcccagctttgttttcaccaagtctttacggttgctgccatccatgaatgccctttccagcttaggttccccagaaaggctctcccaatctgagaaaaataaataactacaaaagaaaaacagaagatgaaagaatctggtattttacaagttaacctgggaattttttttaacagtgtgtttggatcaatggaaattttatccagctgattagagaaccacagtataaaacaacagggaaattaagttgttttttttttttaaagagactgtgggggtcagtcaggagcatcaacagttccaaatagcaactattatgatgcactaatatggcagtctaaaagttcatattcagccagccaggcacagtggttcatgcctgtggtcctagcactttgggaggccaacatagaaggattgcttgaggcccatgtttcaagaccagcctgggcaacatggcaagaccccatctctacaaaaattaaaagattagctgggcatgatggcacttgcccatagtctcagctactcaggaagctgaggtgggaggattgcttgagcccagaagttcaagtctgcggcacgctgtgattgtgctgctgcactccagcctgggcaacagagcaagaacctgtctcaaaaaaaaaaaattcatattcaccttctgaactttctcctctgtttcctttatttgtcctttgcttctcttttttacacccaggaaaacttacaaataccttttaaaagaagctatcaagccattttgctcctcagttttccattctgaggcacagagaacatttccgtcattttcaaggaaggatagctgatataatgaagtagaactgaataatcatcattcacaaagactaaaatagcctaaagcttatccaagggtcctaagacccaattgtgaaattctaggagaaagctaagtctcctataacacttctcaaatgtgaagattgggaaatttaaatttaaacctgaagaaaagcattatcggtgttgctggattgattcagactgaacaacttgtaatgagatattagcattgatatctcaatcccagcctgtatcaagaaagttctgaaaggaatagttccaacctccatctttaaaaatctttacagctaattcatgttagagtaatcatcttaataataatgaagcataagtgatgtttagttgtaataatattattagattgagttagaacacaaaatccaatctcttagctaggaaaacgtggcaaacactaagaataaaattcatagccccaaaacaacaagtatttttagtacaccactaggtgtgtttgggtaacatgtcctcaaataggattatatttaataaactctcttaaagcttctataaataagggcacaaaatagacatggcttctagagtatacagcctaaaagaaatcagaatgagcctttgattaatccagtagatgttcagtgtatagagggagagagaaaattctaaaaatacaggaatcaatatgttttcacatcacttacccaacagttgggtccacggcaattcctctaggatgccccaagttttcagttataagggtaacccgatagcttccatccaaatttaccatatctatgcggttgaccttggtttccactagatagattttattattaacccagtccacagccaggttctctggggtttcaacagaaacattgagaacctcttggatatttaaaccattaatgtcaactgaaaaaacctgaaagaaaaaccaaaattattatatttcttcagcatcactaactacgtggtttgttttgattttttttagctataatcaaatcagaagtgctaaaaatctaaattctcaattttcagaaatttcatgcaagttatcatttaaataaatgagaatcgtattaatggtataataaaatgtaagaagaaataaataaaattccataactctttaagagtttctgaaatttatgtttcaaaaatctccattgcattactccaagatgaaattaaacccatcacactttccaaataagacagtgaaacaaaatttgggccattaaacaaaataccgtcaatatttgttactcgatcccgaattacagttccatttagaagatgcaggtaaaaatctgatttttatcatccagaaaagcagtgtgctttttacattttaaatgatcaaatttcaaaaattactaccaaatatctatccagttttgaaagaatgtctactatttcttttaattaggctcctggactccacttcgaataaaattaaaagttgctcaaggctaatccatataatagactgctttgtttaataggtcacatgtaatagtatagcatggaaaaggtgctgattaacataaaatatctcaagggccttttttgttagaaaacaaaggaactttcccctctactccctctaaaagtgaaaagctatcaacactttgtgctcagggttccattcagctactgaaatttctatttaccttattttgcacggtgtctgtccaaaaaactctttgcaggtgatagtggaaagccacacccacggccactccacgattctgagactccactaggatccggaagctccttccatgaatatcaccaattaacaaatcccgaccattggagaagataatggaggcctcgccaactaaatgcgaagaaggaaggcatcaccactccttcagatgagcaaggatggtgaagtagcttacaaatgatatgctttctgctttttcaaatgctatcttctaggttgtcttacctgattttaacataaacctctgaggcagacagatagctagcattctatccattttacagaagggcaaattgaggcacaaaaaggcttaatgaagcgtccaaaatctcagtaagttaggaagaatttggtaagaattcaagcattctggatgctagtccaatgcactttcaatgacactgaggagagtatttctcagatattttcgagactccttgatggtatgggcaccttagccccatgtgcaactttagattttgttaaacacagaagacattttaaagattaccaggaaatcactctgaaaaagatggtaatggtggttccaaatctgttctgtctgtttactcgcaggtatgcaaaatgatatatgaacaaggtattaattgcagtcttattggcaatagcaaaagataaggaatgatataaaaattgatcagtagaggactagttaaacaaattatgaacataaaagaaggaatattatgccattataaaaaaataattaaggccaggcgcagtggctcacacctgtaatcccagcactttgagggactgaggtaggcagatcacctgaagtcaggagttcgagatcagcctggccaacatggggaaaccctgtttctaccaaaaatacaaaaattagctgggcatggtggcgggggcctgtaatctcagctactcaggaggctgaggcaggagaatcgcttgaacccgagaggcggagattgcagtgaggcaagatcttgccattgcactccagcctgggcaacaagagcaagactccatctcaaaaataaataaataaggccggatgcggtggttcatgcctgtaatcccagcactttgggaggccaaggcaggtaaattatgaggtcaggagatcaagaccatcctggctaacatgatgaaaccccgtctctactaaaaatacaaaaattagctgggtgtggtggcagaagcctgtagtcccagctactcgggaggctgaggcagagaattgcctgaacccgggaggcggaggttgcagtgagccaagatggcgccactgcactccagcctgggcaacagagcgagactcattctcaaaaataaataaataaaaataaataaataaataaataaaataattaagaaataacttcatgtgctgaaatggaaagctctggaaaatatcttcagtacattcacaagatgcagaactgtgcatatagtttactaccatatatagatatgtaaatacagttaaatatctatatttgtatgttcttgtttattcattaaaaaatctctagaactaaaataaagaaacggcaattactcataggaaagagaaggtgaaaaccatgcagaggggaatagttatggaggaaggcatttcactacatatcttcttataatttaaaatttgtgaacatataaatatgttacctatgcaaaaataaacacattgaattgttaaaaatccgctgaacctaaaagttactacacagcaaatcaggtatttctacacaaaaacaagtagaaaatgggccattcttcagtcatgggagcagttaagtttcagaagacaccaaagacacttcaaaatcaagtgttaaataactattggaaaataggagtttatattgagaccttcgtccggagaaatcaacagcgacaaaatgctttggagccctcatctattttttgcagattttctccatgacttttctctactactctgtactactctctacttttcatactcttacactgattccaacaaattacccagagttagtgcattcaaaaaattgttaatccaaatttagcatgtccatttggaaatatccctaaattttgcaagaacactgtgaaaattatttctgtagatagttgtcgcctacttttgtggtaggtaattaattaaaagttaaatgtccaagccaatcaaatgtaggcatagcatttattccacaattaaaggtgggtgacatgatagcctaggcaaagtaaacaatcaatcaattaaaaaatattaataatggtcaccattagtcgacaaattggtccttaataatcaaagtatgaaattaatgttgaccaatttttctaggcagtaggagccatccctgatttgtaatgataaagccctgccaacaacaaaaatgctgataattctgttgtcatcagaaggaaggaaagaagctattagaatctgttcactgttcagagacacaggtgtccataatttactcacaggaatcattagctttgcaatactgtccacgctccaagatatacccttcttcacagtggcacaggtgacggccaggtcggctttcacacttctggtcacaaattccccatatctggcaatcatcaaactctgccatatggaaaatacacatttgtagtcaaggttatcagcatttattaagcactctctgacaaaaatcctagataagatggccaagaatgtggtgttgcccatgtctaaataaacaccctctggaattaggcacaggttctgagaatttataacaaccatcttcatgtaaggaaaaagaacatttacatcattttttaaacctacatgaaggataactttacagaaaatgcacaacacttcctgaattcatagccctatggtactgcatttcatttattaatgttagtctacaaatatataaattttggtgtaaatgtttcccttcaatactatgctttccaacatggcagccactaaccccctgtggctatctaaatgtatctttagattaattaaaataaaataaaattaataatttgctttcctagtcacttgccacatttcaagtgctcaatagccacatatgactagtggttacaatatgacagagtgaagatacacatttacatcactgcagaaagttctattggacagcactatttctgaataaagtaagacctgcctatagacagcccctcaggaagaaacaaatctatgactgcaataaagtacttggaaaggtctatttacccagctgtctttcctctgatgtcaaaaaattataaccaaaattaaattgaacttattttcaagacatcaaaaatgtcttctcctctacttattggttaacttattattcactcatttagtaagtgttcattgaagtcccttacatgacagagctctgttcattaccagagaagtcccagttctactgtttaaaaatagttccaatataattgacataaacaatagaatatggaggggagaacacaacaaaatattagaagagtctttcttaaagactataaggcttcaggggtgcagaaattggtacatctgactttccaagtccacgtccactctccatcatccttcaccctcctcgcttccctgggaggatgacctatacaaactataacaatagagttcccacaccctctggtttcaggaagttctcaagtagattataatttctgaaaccactgcactcccaagtctagaattctccagatttctatgatctgattacatttgcagcaactgtcagagttgtgaattgggttcaaccattcctgctgggtggcccaccattccataacccaccaaaaggccaagtttcttctcttttcttttctttttcttttttttcttttttttttttttttttttttttttgagatggagtcacagtctgttgcccaggctggagtgcagtggcacagtctcggctcactgcaacctccgcctcccgggttcaagtgatccttccacctcagcctaccgagtagctggaactacaggtgtgcgccaccacacctggctaatatttttgtatttttagtagagacggcatttccccatgttggccaggctggtctcaaactcctgatctcaagtaagcagcttgccttggcctcccaaagtgatgggactgcaggcgtaagccaccgcatccagccccaagaaggctcttctaatgatcccattttccctgcagattaaacataacaacatgagccagcatatctttctttccaaggaccgtgactaaccagaggaaaaaaaacccaatccgatctggacactaccaagtgaaatgccacatgagggtgtgaaatgccctcactgatgaatcccttctgtccccttaactcagccctgagaaagctccacctaaggctttgcctcagcaggaaaaaaagtacaggacattctccctcaaacccccagaatgtcataacttcattttgaatgcaagatccatgagaccacgtctaaggatctggagtcactctaagcagaagttctgatgtcaaacagaaggaaaccaaaggtggagaagtcataactaggaattctctagcacaaatgcccttcctatcacctgcactacaagtggtttaaagatttgaatgagtgggccaggcacagtggctcacgcctataatcccagcactttgggagggtaaggtgggaggattgcttgagtccaagggtttgagactagcctgggcaatatggcaagggtttatgtgtactaagaattaaaaaaaaaaaaaaaaaaattagccaggcatggaggcacgtgcctgtagtcccagctattcgggaggctgaagtgggaggctgcagtgagcgtgataatgccactgcactccagcctgggcgacagtgagaccctatcacaaaaaaacaggatttgaatgagtgtataaaattgctgtcacttttgtgacaataagattgtatccttggatcactatagaggaatatgaaggttaattaacatccatcagcagccagagtgaagacaagaaaaataaaagtagaattgagggttttcgtgagagtagaaaagatagtggaaaccacacaaaacactaaaacactactttacaatccccctctcactccaatacctttatctatttttctttcctttttattctttgtctcctcccaccaacaaatactgctgtgaaaatgactcaaaaacccctttttaactgagccccccttggccaccctctgatccatctggctgtgtgaaaccccaccatgctgaatgacctccctgccctcactctgcaccacgatgtcattctgtcaacaaacagcatgtcctgtcaatcagaaacaatgagcccagtaaactgcttcagcatgcctcagagcttccactgccaggtcaacactaccagaggcagatgaatggtagaaagacacaagatttcgtgtcaggattattcaatgttattcttgattaccaccgaggtattcactggggagccatgtctaagataataaatgttgcataggtttccaacacctgaagcctgtgtaatgcgtcagccatgcagagggttatagccatacagagagtatttgttgaaatgaaatgcttgagagagcaaaccaaagcaacaattcccctaaaaattcagctcagctgaaacaagtgtaactggtttcctaacgtcatgtatttaaagagttctctataaagagagaaaaatacagtcttctttgaaacaaatgtgaaataaatgttaacccagcctcaaaactcagaggcaaatgacacattcttgaaggacagcaaaggtcacagaaaaggtctctgcaggtggcaggaggcctcatattcacaaaggccctcaaatgtagacttttgagattatctccaaatgaggttgtctgtactaaagtcccagaaacgcgctggcgggaatgaaagaagatgtctgttgtggaacttaaaattagtgccccggtattagaacacactacttccaatgtgttattaattgtggtatcttctctgatcctgaaattatcctgtgcacacataatactgcaatattctgccttacattcactagtaggttaaatgcaaaattttataaaacaagaacattgttatgacagcctttcgctttgtgagaggctattgaaaattgaagtggcctgaatctctgacatttagaaaaccctagacatttggaaatacaacccaaggctcaccacagacttatatgttggaaaatatggaaaatgtgttatctgggctctagggtggaacaaaaaactgagaacagcttgtggggcatcacaagactgaattagcgattctgaaagaacaaatcacttttcctgaaaggacttcatggcctatcaagtttcaactgtaagacagctcagccccaactcctctttgggagttgataaaggaaaaagagagaaaagctgatgtaatactgagaatgtggcttctggtatttctattggaacttcttttctactaagagaaaaggaaaatgcctaaagaactaaaaggctgggaatgggattggcagctgggtagcagtgaggggggaaaaggagcctgacatttgctaaagacacaggagtggcctcacacccacagacgagccccactctgagcagaagtgaggctgcccctttgcgcagggctgcctgaaatccaggcagggctcccagagtcaggtcaccacctaaccaataagggcattcgtgtgaaaagtatctgtaaattacttgaatgcattcccaatataatggtaatgataacaataaaacacaaaatgtgtcctgcaatcttatttaagtccagttgcagatcataacttttatttataaaatgttttaaaatgattagaaatttgggggccttcttaaattattccagagttcacttaagtcacttgatcttaaagtaccttgttgaatatagttacttaagaggagcaattagatgggcaactttgggacgtggtcctgatattaagaacctacagttacccactatgaacacaaggaaaagctcaaatggattgctttactggatataaaaatctaattttttttggcatatggtaggtaagtgagcccaacgattgtagttttcagtaacgctgaggagcagactttctcaagaatttcaagtttaatttgcaaaccagagtttatttctggtatcaatacatttttctgtttgctagcacttccgctgaagaataataataataataataataaagaaaaaaagaaaggcttttctggctatgagtagttgttaagattagctgtatttgacaaagtataattatgttggaagcaatgagctgagactaaagactgaataactgcattaggtttatctatattcaataattttttccaaatgttaccaaatagttctaaaatattaaaattttaatattttaatattaaaattttaatattttaataatattaaaataataatttcagaagaaatacttttctagaagcatttcttacacatttcatgtttgttgctatcccaaaagccctaaagaatacctcacatttctaaggaatatcaaaagaatataaatatcctgggaaaattctgaatcattttggagccccatagatgactaccaaattttaatgaatagtttcaattgccttccagatgccttttcccaacagcagtaaaaatagttttctttaaactccctctgtgatcacttcctgctagtatgtttgttgttcatgtatcaaaaatcagatagaaggaaaaaagatcagagcaccaaaaactcactgagaaaacaaaaactgatgatagttggtcaagtctaattctcccatcataaggccccgtcctaatcacagtgagatataaagctggcatcaaaatcaaaaatctcattgggagaaatcatttctgaagtcagagaggagagatatgaggaaatagttggtgtactggtgtctagtttaatgccagccaccatctggaagcaccatgataaagaatctgctcatcttgaatgatagttccaagtggatgtcacaatcagtggaatgagtagccagcccagcaaaggcactggcccaccagtgtagtcacctgagcaatgacctggtgatcctctgctgtgtcaggtaacaactctttagttgtgggatcctggggatgcttgtgcatcctggagaagaggccaggggagcaaggtagcggtgcttgctgggctcaggcagcagctatctaccaacctcatggaagtagttcagtattcaataaccagtatggctgcaccaatcctgatgccaaatacttgaaaagaaaacagaaaaggactaccgccctcatcaagtaatggataggttccaggtagctagtcaactcgctcatgacagaaccattcttttgccttgtacaccacaccaaaccttctcagagttaaaattccctatttgccaggttttctgtgaggtctgggttgctctttgttatgacagaccatgacgactctccacaagtgcaacctcctagatgtcagagatcagggcacccatcagtgtactgtaatgaaagacaagtagccgccgccccccatcacttaccaacacaggtacggctgtcattgtggttgatgatataacctgggggacaaaaacacgctcctccatacggcgtctcatggcactggtactggcagttcaaggcagagcacagagtcatacctaaacgaagaaaagaactttgttaaatgaatggtgacctctggacaagactgattaatctaatagcttctttttccatgagtagcagctcagtaagcatgaagtagatgtacagaaaaatctgtcacccttcaaagcttactgcaaaactttgcaataaaagttcaactgagacaggaagattgcttgaagccaggagatcaagaccagcctgggtaatgtagctacacctcatattcacaaaaaattaaaaataaaagcattagccaggcacagtggctcacaactgtaatctcagcactttgggaggccaaggcaggaggatcacttgagcccaaaagatggaggctgcagtgagctatgactgcaccactgcactctagcctgggtgacagaacaagaggctgccttgagtggaaacaaaagaaaagaaaaagctcctttttaaagttataactatgtgcaagtataagtcattaaaagtcttatttatgaaaaaaaaatcaggtcatgcatgggtctatctttgtgtctacatagtaaaaagggctaagaactcccaagtgactggagcaagaataagccctagaaatattaactgtggctggcttcaagagatgggatttcaggtgattatatttttttcttttggttaatttttattttccaactttcatactgtgactacatatctcttattaatttttaagcttttttaaatgggctcccaaatgaaatagagaaaaaaatgccatagaggtctctgcctgtttaaatattatgtacaatttttgtcaggaaacaaaaaataaccttggggttgcagttacatgggcacttctaggcaatcacaaatttagttagagtatattattgatgaaatcaaggttttaaatggcatttccttacaggaccatcagctgtccacagagttgatgggttgttggtggggtgaatattctacagccccaaaaaaggagaaaaaaaatccctagttccagtcagtttcctcataaatgaatgtggtcacacaagacataatcgaacaacactgtgcatggccaactcagttttgccattggagagtaactcaaggtacataacccaggaaccagaagctttttttttttttttttttttttttttttagtacagccagacaaggcctttttccataagtataagccaggtaataaaatctccagaacatctttaaggtcatcaaaattgccattgaaacaatcctccctgtgtgtgcgttagggattaggaacggggagttgctaaaaaattgttaggctcttcccatcaatagatggagtctatttcttccatccactctgggtttggccaagtgtcttgctttggacaataagacttgagcaaacttggcataagtagaaccttgaaagtacttgagccctaggatttgctctttcagcctctgggtcaacaaggctaggctagcccaagcttttactgcaacatcctgacgtgtgagtgagctgatacaggccagaggaactacctagccaacccacagaactgtgagaaataagacacgtttctcagtttatgccactaagtcttggggtgctttgttatgcaaatgccaacagatacactgtatttgaacgtctgttctagaaaacagaaatatctttatctgaaagctacccaggtaaatgtctatactcactacagtattttccggtactagtgttgttttcatcttctcttcctgggcaatctaaaatcccatcacaaactttataaatggagatgcatcgtcccgactctgggcaagaccattctcttggggaacatttatgaacatcatgaggaccgctttctgtggggggaaaaagagagagttacaggccataggggaggtacagccagctctttgttaatcagtggtttacagaggatgtagagcaagttgaacaagagaaatctataaatgatctacattttacaataagttagtgatttctaactctaccactagtcttttactgagattctaaggagaggcataatggaattactccacttttcctggaaaaggcagcccccagtagggttataagaggaagaagcagatatgggcctcaattatcgacaaactaaattcatgatcccctaagaaaagatgtagttatttaaatcatgaattatagaattagggccatcaagttaggtccagaattacttgaatttgtggttgggctttttgatttgctttgtttatttagtgaaatgtcaacagtataagaaaaaccataacccaaatgtagaaaaaccactttctggaacataaaaacataaaacatagttttaacaagcatttcccttatcatacctgggattggaatggtgcaggtaacttgctgtagggtatgggtattagtaactgctaaattgttggaggtactgctgatgatatcagcaacataaaagggtcaatatcagcaacataaaagggtgaatatcactggcaatttccttctcacggaatctttaagcacttccctggatagtagcttctcctacacttaccatccccagctccaacccacgtgttcccaaggtggcctctctttcaccactgagtgtcagtgactcatttgggaatcagaatttacaaaaccaaaacaaaaaaataagctgaactgttaccaaggttcaaagtcatttttaaagattgtaaggtctaagacaaatgacattttccctattttctttccttccccagcctattagttttatatagttttaaatctatttaaaacaggcagtcttacagggagaaagtcagactggggtatagaagagacagagactgtcctacctattttgccttaaagatagaagggagaggattataatttaatctgtatttgtgttctgaatcttcttaggagaagttagcgcagtcacctccgtcttccccacccactaagttcctaaacaaccccttcaactccagccaatcctgaggcttgcttgtcacacaaaatttctaaaaaggaaaggagaaaaaacaagcgctggaaaacacttgaagaaaatgcttttcagtaggaatctcttcccctccttaccacatccatcttcatctccattatctttacagtcatcttctccatcacaaacccagttttgataaatgcatcggccactggggcaagtgaactggtaaccaccgcaggtcggatagtctggaataaagcaacagctgcactccaaagacacaaatcaccgggaaaaactgaaagtgctctcacctcactgcctaagcagtactcctagaaattgaaatttctatatcaatttaatcccttagacatcttgacaaaaatttttaaaaaggaggaaaaaaaagagagagaaagaagaagataacagcagctttgggtccaggaaatgaactcaggtgccggtttctgtttttcaagattaaaaattagatcagcctgggcaacatggtgagacctcatctctaccaaaaatacgaaaaataaaaataaatagccaagcatggtggtacatgtctgtagtctcagctactcaggaggctgaggtgggaggatggcatgagcctggtgggggtgtgtggagttgcagtgagccaagatcgcaccactgcactccagcctgggtgacagagtgagaccctgtctcaaaaaaaaaaaaaaaaaaaaaaaaaattaaaaacaagatggtttgcaatgcgttggcacagaacagaaaatgcagacaaagatgctgcagacatgacaacatccaacgttctcatactttactacaagctccgtaattgctaatctatgaccaaatgattctgagtcgaccattccatgatgtcacattctctttaattctctgtcactgaaataagcccaggttccagaaaggaagtcaggcatggctcattgaaaattagggtgatatcgaaaatatttaacaacaccctaaggcatgggtaccaaccaatcaaaagaggtgtggagggaaatcatacattctagtaaataaatcaccacgcaaagctgccaacttactgaacatagtaaaactctttcacagagtcttctaactttactctttccaaaaaacataagtggagaggtggcaacaataagagaggtcatttgcattgcaggcaacagcatggacataaaagcaaggtcagcgtgaagaagtggaggcaagaaagccacctataccacactgaaactttcaggctgggcgtggtggctcatacccataataccagcactttgggaggccgaggcgggcggatcacttgagatcaggagttcgagaccagcctggccaacacggtgaaaccccatctctactaaaaacacaaaattagccagacatggtggtgcatgcctgtgatcccagctattcgggaggctgaagcaggagaactgcttgaacccaggaggcggaagtggcagtaagccgagatcgcgccactgtactccagcccaggcaacaaagcaaaactccatctccaaaaaaagaaaacgaagaaaaagaaactttcctgaccctccaactttaatgcagcagaaatttcaaagtaaagaggagagttagagccactcctaggaacttcctttcccttaaaaacacttctctcattctactatcaaggttgtcagaggtatgggtcatttgagaatccagtgatacaatatatcctgtacccctggagcctaaggaaagaaggcaaactgtccatcaccagccctttacatctacacagatccttggaaaataaaggagcccaggtcgagcaacaccacaaaggcttgtgccaagaccccctagtgaccgtctgattccatctgccatcaaacgtagtgactcttctccttgaaaaaagaggtacattggtgggggagcggggggataaaacaaaacaaaaccgaaacaaaacaaaacactcccaacaacatgacccagcataaagaaatcaccgtactgcaagcatgttcgtcactgccgtcttggcaatcattgtcatggtcacagacataagcacgagggatacactctccattgccacatgaaaactcattgtgcaagcatatctcagctgcaacagaaagttaagaagggaaagaaaagagagaagttaactccattgtagccatttaatctcaaaggaagagcatctccagtttaaaaagggattcttattaagcagtggtgtgctggtaactgtttaagaaccagttatccaggaacaaaaaggccctggtttgtagtgtttgccgatttccagtgtgtaaatactcctaccaacggctgacttcaaactaccaacatgaattcactgaacctgaacttgggaagagatgtacatattggctctctcaaaccagtataaaccagcttcagcacacaactgcacatcttgtgcacaatacttactgcagttgatttcatctgaggagtccctgcaatcaactttccaatcacacttctgactggtgttatagcaggccccattgtcacaagtaagctgctcacatgttgggtactctattgtaaaaaaaaaaaaaaaaaaaaaaaggaaaaggaaacagtaaacaaaccttaaatttccttcagcaaacatttattgagtgattactatatgcaagtcactaaatgcatatattgatacacaaaagaagtatgctccctggcttcatggagagtaaggctggacatgggagacagacattaatcaaataagacacaaatggtaaattacaaactgggataagtgctaatgtggaaagtacagaggactgtgagactgcatagcagagagatttgggggcccagaaaagtatcccctgaagaagtgacttttgagccaaaagatgaagaatgagaaagaatttaactttagttcaaaatcaaacattcttttacatgatacagataacatcccaggaaactaaagtaccactgcacaagcttggaaaaaagaaaggccatttcttccactggcgggttgcagaaagaaagcaggcctagagttcaggagccctggcggcccagaggtaccactaagcagctatttactgtgactcaagcttcatgtcctctccatgttgctacttccctatctgcacatttggataacctactgcacagggtagagcggcctgaaaagaccatgtctggtaaagcatgttgaaaagcataatgtgctttcaaagcacaaattgttgttgccacgttatgtacatatgaccacctcactgctactcactggacctggttttctaggtcacagttgaaaatcaggaagtcccttacaggaataacgtgctatctgtccctcctctctacttgccagacttggaccacctgtctctcatgacttcttactggaggctttattctgtggatggttgatctctttccgccatgacataatgaaactccctgagatcaaggatcctgtcttactcattttagaatccccaacaattagtacaggggtgggacatttctcactgtgcacacttagtacaggggtgggacattactctctgtgcttgagaaatgttcaatgttgctattatttatcacaggtgaacattttagttcattcggctttttaaaatattttgaagttctgccttttatggcctttgaataccctccttttcacaaatgtggatatcttccttggtctgaccatcttcttcatgaaagattatttttgtagtgattatcaggtcatcttctgatttctttttaaccaaggaaaaggtatgtcttaattgactttgagtctcaattttgcacttaagaacccaatttgagattttatagagatataaatatattgaagataattctttggatagtcccaagtcttttcaagcagaagccatgcacaaaattctgtgctgaaactgtactaaacttgtgccatgttaacaacttgcactttttaaaaaaatggactctccaatgatcttttttttggtatagtaaaggaataagcctaactcttctcatctccagaggttcaaagctagtttattaagtgtccttaaatatctcaattgccagagttacatatagtcaatcatatgttaaaatggaaggcatttttaaatagctggttaaaatttaaaattttttctgaattttattttgttttttaatagtccaaaagtgagccagtgcctagagttattgcgtctttcctcgctgagatgatatgccttacaaatgtgccttcaaatgagtcacacaactctcccttcaagtgatgtttattaattctcccttcaagagatgcaaaagaccaggtgaggtcagcaagcaattcctttgcccctgtgagccagatagctcctagagtcaatgtgttatctagccttttaagagcagcagcaagcagaagaaaaactcgtagaaaacccagctctttgcaatagataagctatctgtctggaggaaaattaatctgggcttgaacggtggctacttcatttaaggtgataattataaatataaagaatctggaataagtgtgctggatggatctctcgttttcttcatcctgctttttgagagccagtgccagaaaattgaaaggggaaagattaaaactgtaaccactgacatgactacaagtttactgacaaggcccattccccacccaacaaacaagaagcccagcttgatatcatcagggagggtattgtgatggccagaggtcagcagtttgacttttggaatgaggaacacacagctttcttgtctccatccacactgataaagaatcactctcaatcagcagaggacccctctcaacccctgcacaccttgatctcttcggtgcatagttaacctgggatgtatactcataggaaagattgcacagagctccctaactccaccaaatactgaaaatacctgaaaatctgtttctgaatggttttccctctttggagacccacacagagacaacaggtccaaactgtcaacactgagcaaagaaagaaatgaatggattctactaccattgctaaagatgttaatgagtttcaatctactccagaaaacaataattcacaatcctttgagcttccaactgggagatatctaaagtcttattttttggttcatttgcttggcaagcctaagtctaaccttcttcccacagagcaaatccatcatgtggctataatgtcctgcaagaatttaagtatagggtaaagtgcaatatgagaggagaccatatataagaacaccaaggaaactcttccttctgaatttggttttaatggaaagatcaacaagtagctataaattaagcctcagacctttaaggttttttctaacacaaaaaggtgagaatatccttcctcataccactccttgcttcccctttctttactttctcccaatcccaaatgatacatgttcagatttgttcccccataattgggagctgccccaaaattatgcagacaagagtttttatattttttcactgttaatgatttggtttgaagcaagaaatttctatgctatagttctgtttacataatcagggaggagggtgtagaaatgtagtttgaagatcttgtagacctcttagaatggaaatcattttaagcagagtaagatacaaatataaggcactgttcattattatcttgacaggaagactgcagacatgttttattctcacaatttgacaacatggctgaggacaacatagaaaaaaccattattatgaagaaggaatcttaaaagtaggttaggaaacttaagccaagattgggaaacacacacacacacacacacacaagaaattaccgatacaagtccagcccagacacctgggacttttcaaggtcctagagtcatcctttataagttactttatgttatttcctctggctccaagacagattaatccagtcaatgtaatgatttgccagaaagaatctaccagtttggccaccagcacttacttcaagcgctacccacaaagttaaacaagcaatcatcatcatcatcatcatcatcatcatcatcatcatcaataacatgtattaaaaactatgtgccagacatgtgtcaaagtactcaatatgtataaactcatttcatcttcataacaacttcatgaagtaaatactatgatgactcccattttatagagtaagaacctgagcattaagaggttaaggaatttgaaaaaggtcacataactggtaaagttggagagccagaattcaaatccaatcaacctggctccataacccaggttactaaccactaccacagatacatctaccacttataggctgcagagtaagtaacaggaagaagcgaaaaattaaagaagaaagaaattgaatgaaatggtaatagaaaattcttaaaagagattatgaaaagaaaaagaagaaacccaagaggaaggggggaagattttctttctgccagtcagtttcccatccacattaggaagaagggaaaagtgaggccaactctagtttcccacaacttatggcatagttaacaaagtacttcaatatgatataatctaggaattctaggaaacctacacaggaaaaataactttccagaaggagtaccaggacaaacaggagagtcaataccaaaaaacaggccataaagttagtctcatgaaggtaccaccacgactccccaaacccccattcctggtgaatttcaagtccctaaagtgactgccatcatggactagctcttagggaatgcagtaatatacaaggaaaaaaacagagaagcatatccttccccagtccaaaagtaatttgaagaagctttcaataaaaagttatataaaaccagatttattaaaaaagaaattcagaaagaagaaagaaagaaggaaagaaagaaagaaggaaagaaagaaagaaagaaagaaagaaagaaagaaagaaagaaagaaagaaagaaagaaagaaagaaagaaaaaaagaaagaaagaaaaagaaagaaagaaagaaattcagcaccttggaaagagaaagaaaatatggtcatcccgaggacttgtagaattgaactaacatcaagtttagtctgggtggctttcaggaagccaaaggaaaaagagaaataaactaagttatctagttttccttagctcactccctttgtactaactgggtcttaagcctgagattccttgctggtctctatccacagtgacctaatcttagacctcaactagaaatgtgcctgagagggttgctccaaggagtccagatccacagcactgccttcttcccataacagagctatcaccaaaaactgcaaaggagataaaaactgacatagttctaaattccttaaaaaaaaaaaaaactcacacaagctctattacaaaagtgaccgagcaacaagatggaaaaatgtgcatcaaatgctccaaggaatagtacaaagaagtaagatgccttctaaggggtaaacaaatgtttataatgtacatcatgtttagtggcacggggctacatgttttcattgaaagccagacaacaccatggtttcatactttagtagttattcccagggacccacctgggcagaacaaaagacaaaatctaatcaaagagacaggaaaactagctgcaccccagcattataagagtagccactttccaatcactagaaatggtgtggctcagcctccctgctggaaatgtagccccaaataatttgaatactcatcagcaaatcattgctggatgaatgtcaatatcctagaaaccagttattctacagagtgctgccttcttcttaattagaattctcttgtgctcaacatgtatttattgaaatctgacttcatagatactgtgctaagaattaaattaaaaggtaaacaaaattacaagtgaagtagcaattcccacagcattttattaatcaatccatacaaaaataattattgcacacctatagtgtgcaaggtactaaagaatgaaataaaatcccatttctcatggaacagacattctatttgggagagtgaaattacagctattaaagtaaatgtcacaatgggaaaaaaaacttgcaaaaatagagctgggtaaaaggtaaagagtaactgtggggagtagctctctgagaagtgatatttgaacaagaaccattaggcttagcataatggcagtcattggtagcattgaaagaatattttcaggagattggtgaagatgaaggactattttcagtgggttctaaaaaaaggacaatcagttggatatatcacatatgtaaaaaaaatttttttaaagaaagaaacaggacgagggtaaacggaaacagccattaacgttaatgctaggaaactctgttgtaaaagggagcagagtaattggcaacagctaagagggatcttaggatctttttaaagatgggggatatttataacatccttgtatgatggaaactaaataaaagagagttttctttccttcctccaggtttcagggctctgaatcctatctcaattgtgagaatgctaaaaaggtacatctgtgatgtgacaggtaagatggggtcctttggagagtcgcctgcttcttctttctggcttcagggagagagagaatagcaagggcaaggctcgctgggcagcttaaatgtggaactgagtttgaagaacatgttcttcatgcaccctcacagtccacaaaatgactttaaccatctttttattcccctcccactgttccctcagctggagtttcagcagttaaagatataaagaaaaatgtttaaattctaaagagcagaaagtcaatagaaataaaacttctgggacaaagcagccccagttgcaggcagaccaagtactgctgattaccagcaagaaagccttcattgtaacagggattttaccctttctttggcattcctaagtaacaaaagagaagtgctgcaaaccaacgataattagcaatagttttattcacaccaaaatcattctaatatggtgcttgaaaaagcaaaataatcttttcacttaacagaaaaaaactgtactatttttgagcaactgaaagtcacgtcaatatattaattgaatgacctataattgctgcattgttctgatgtttatcttagaccctgcatgagtggtttttccttgatgctaatcccattagaagtaaaatggaccgcagttttgaatctctctgttccttaaaaaaaaaaaaaagttaattgacaagctgtttaatatgagatgccattttacagatgaccagattgaataataaaagaactaagggggaaaatgagcttttacctgtttcacaggttttaatatatatatattcaaaaatttttctaaaagggtaaaataaccaccaataccttatgcatataaagatgaagcagataaaaagaccaaacgcaataagaatctctcatactataccacatttatctcaaaaataatctttttgttgagaccctaatatcctccccttcctcaccatctcgaacattctctcacctcctctctccctgcctgcctccctgagaggactcttacacaccactctttgttctgtaaaggaatgcccggaatggacacaaggtactctgtcttggagctcagtgtcttgattttagaagcttgaaagggtatgaactacaacctaggggtctggaatgacaggcagggctacaaactacaacatcaagctccctaatccttttgaatattagagggaagaattgagcccttctttggagcttttccaacatccattactatttttaggtggtttccaggtacctaatatattcattcctataggccattctatttctgagaaatagaaaaacaaaagccccattcacaggctaattctaagtttgtccacaagtaatgatttccatgcatcgtcactgcagaaataataaagtgtcatgtctcatgaagatgatttctggctaagcctcatttaatctttgatcacatgaaaacattctaatttaaagcaactaataacagctgttatatatctaatgcaacatttaaaataactaagtactgctatgactaaatggatttcagcaatgatcatcaatggctactcacatcacagacagctagctatcctgtgtctcctaatgaaaatacacagatttatataaaaagtactcttgccttcccttgtttccccaccaagaaaatccttgcacctgttcagtcccctaaatcagtggttctcaactggatgatttggctcctggaggacatttgacaacgtccagagacattttggattgtcacgactgggcaatgctacagacatctagtggatagaggccagggatactgttagacattctacaatgcacaagaaagaactgtccggtcccaaatgtcattagtgtgaaggtcgagaaaccctgctccaggtctagctactaattgccaagaaatacagaggacagagaatgtgttaaaggacatcaggggacacaatgaacacaagccagactgtgggaaactccaggacaagtgacctgggtttttttttttaacaagtaaattgcaaggggtaaagaacagaaatagaaggaaaccccataaattgaaaggcttatgagacatatcaactaacttgaacataaagattttatttggactttgatttaaataatcaaactataaaaaataacaagatgattggggaattttaaaaactgactcaatatctgattattttaaagaagagttgtttaatttttaggtgtgataatgatattatgattatgtttcagtccttatattttagagataaatactgaaatatttacaggtggaattatacaatgtctaagaaatacttcaaaataatggggagaataaagagaataaataaaacaatattagttatgagttcatcattgatgtaattgagtgatgcatacaaaggggttcactatacacttcatgcttcttttgtatatgttaaaaaaaaccttccatactaaaaaaggtttagacaataatatgtaaaaataataaaatagctaagtaacctttaaacaaaaataagttatacgtttctattcctaaagcaaaatcttttaagagcacaggcatatggtttagacctaggttaaaatcctggctcccctactcttacatcttgataatctttacaatctctgtaaaacagagctggtcctcatacccaccttgcagcattgacgtgaaaagtgggtaaggtggtggctggtgctcggtgactggcagttccctttcccactttccacaagagctttaaacaaagaaggaaaacaaaatgggatcactcctgcaacccatcccctatactagcattttctaaggactttgatcgaggccattcatttccttcttgtatatatctgactgtgaccagatcaaagcactaacaaaagaataagaagtttcttttctacatttcctctgatttctgaggtttttttttttacactgctccataaatgaaacttagctataaataaacaaggtagagggaaataggaaagaatgcctcactgcaaaatcccttacatgcatgtgattcattttaggtcacagtgtgccctgaagggttcatgacttgtatgattccagaaacagtaagccaaatttggttttctttccttagtgaatcattatttcaccaactatttgtacttaaatttttttaaataaaaaaaaacttgattaaaaattcctgcccagatataataacttacaaagctcatttcctctgcttcgttcccttttacagcagctacttacatattcgtatcctgccaggtttttgccagaaggttcattggcaaagttgtgagccggttgtattagtgactttagtcttggctgcaaacattctgtttcagctgacttttattttccccaaagtagcagttcctttagtcccactgcatttgcaataaagcactcattttcatctacttgtaaataagggataaagacacagacttttggctggtggtacaggcctctggtggtctcttaacttgtacaagataggactttctccttctgtaaataaagccctccatgaagagcaatcaccagacttggaactagaagacaaattaagccctatctctactatacaacctcaaacaagtcacgcttctctttgaagtttttgtttattcataagagattataatagtgcctgccctattgtcctcataaaggaacctaatagtaacaactagaatttatataatgctctgaaatttataaaatgctacaaaatataacatatggtttatcattattattaatcaaaaatatcttcttcatttgcctaaatgaagaacctactgtgtgctttacaaagcactgaaaggagaatctttgacccctaaacttgctattctgtggcatccagacacacgctaccatctctaaacttgccagagtttagtctaaattctttgcataatttccagagtgaaggtaaatccaaagtggaaacactgtaatgtctttcaaaaaataaagacatatgcacatgtatgtttattgtagcactatttataatagcaaagacttggaaccaacccaaatgcctatcaatgatagactggataaagaaaatgtagcatatatgcaccatggaatactacgcagccctaaaaaggaacaagttcatgtcttttacaaggacatggatgaagctggaagccatcattctcagcaaactaacacaggaatagaaaaccaaacgccacatgttctcactcataagtgggagttgaacgatgagaacacatggatacagagaggggaacgtcacacatgtatcccagaacttaaagtaaaattaaaaataaatagataaataagaatatttcagatgaaaattagaacagaactgtactaggaactctgctaggaaatggagagacaatggcaaatagcacagacatttctcccaaagaaaaataacatgcaagggagaaagcactggagaagggtcgtttttaaaaatgcaccatgtggtcatggtatggatggaagcataggtcttgcttttgcacatatacaagtatatcttccatgaacagtatagtttgaaatgtacagtgactagaaacaatttgcttgccataatcaatgtatgttagctcctaccctagtcacagcaccatattgggaagtttagcaaaatttacacaagatagttcttttatcagaaagcataaaataaaccatttgtatcaaaggaaggaatttagagacaatccagagaactaaaattaaatcaaaattataaaacaatagaggagatatcccgtgagaataggctaaaacttgaatcttccgttggagacataataactgaaaagtttatgatcaagatttctaaggtacacaaaaatctgctcaccaattaatggaatactgggataatttcttgaagtttgaaatataaatttaagagcaaacaaaaggaagtacagtcaggaaccgcatatggctctttcggtcaacgacagaccgcatggactacatgtactacagtggtcccctaagattataataccatatttttgctgtaccttttctatgtttacatatgtttagctacataaatacttaacattgtgttccaattgcctgtagtatttagcacgggaacatggtgttcaggtttgtagcctaggagcaacagtatatgcctagggtatatactgtttaccctaggtgtgcagtaggctataccatccaggtttgtttaacaacactctatcacgttcacacaacaacaaaattgcctaataatacatttctcagaatgtgtccccctcattaaatgacacatgactatatctttatacagcacatagtaaatttatgaaatgcaggactgcacgaaaaggcctgtcagaaatatatgttatatgtatatattaaaatatatatatattaaaaactcaaggaacttctggaaaaattcataaacgctagacttgtaagaacttttcagagaaactaggggccagacacagtggctcatgcctgtaatcccagcactttgggaggccgaggcgggtggatcacctgaggtcagaagttcaacaccagcctgaccaacatggtgaaatgccatctctactaaaaatacaaaaattagtcgggcgtggtggcgcatgcctgtaatcccagctactcgggaggctgaggcaggagaatcgcttgaacctgggaggtggaggttgcggtgagccgagagcatgccatcacactcagcctgggcaacaagagtgaaactccttctcaaaaataaaaaataaaaaacagaaagagagagaaactgtggtatgcctgagattaaagacaattatatggactataggactgacacagcagactaattcctatcttctcatatcctaacacttctatataagcctcgaaagaggaagattgttctttacttacctgttactagataatgaaccatgattgcactttcttattttggtgtggtaatatttatacattatacatagaatactatgatttatatgtcttattttgtggtgatcagttacaaagagatatagtatgctgctgttataggaaaagacattttcaaaatgtaacacttttccaaaggtaatctgaaaaatgttgagttcataaaagcaggaaaactagtgagaaatttgacctagaaacttactatagctgtgtaataacagttaaaatttaccaaacttgattctgtactcaatgtatttaattatccttcctttcagaatctatgttcatgttaaaagtttcttactataaaaaatacagaaacttgatgcactaaggcaggacactcttagaatgtcttgttaaaaatagactcttatcagaacatcacccctaatccacaaaagaatctgccaagagattgcaataacaagaggcatattgtaggcatttatgtccatcaacaaatctaacaaattgattaaaatgccaaagggacaagggtgaaaccaaatacagtgcaaggactaaaacagactcacggcagtcattctcatcagctccatcggggcagtctctgacgtggtcgcacctgtattcacttgggatacactgaccattggagcatgttatctgatgacttgagcatgtactttgtgctgcgaagagaaaaaattattacttaatttataattattgctagacacagactaatctattgtcattaacaaggatattggaaagcataaagttcatagggacacaaggtaaagtacctggctaccaccaagctgagcttacaaagcaaaaacagaagtataatgttatcaaaatgcccagagaatagtgtccacactcaagcatgctatgtacacaattacgttatcaacatgtgtaaagaatacaatatagattttaaaactatatggtaaaaagtttaatgaaataaaaattttgcaagtataggtattaaccaaggacccccaacccacccattgaaatccttgtataaacaagaaggaaatataccaaagctttaatagcagttattccagagtggtgtgaatatgaatatgagtgattttatttttttctatatagtttcctctattctataaactgcctacattgaccatgtatcaattttataaagagaaaaaaatttaagctagcttgatttcatcccatgttgattagtataggtgaaagcagggcatcagcagttcatgaaatttgcctccggataaaacagataaaatccagtgaactgatgcccgcaagcatgatgtgaaagctatcctgtaaatctgaggcaggaattaccataacatggtaacattatcttatcctgggattttaaattgtctacatacaaagagctttgggggaaaacgtgatcatctaaaaaatataatataatcccctaatggaagaaaaaagatttgctctcaatttttacaaaacttcttttttttataattccttttttattattattattttactttaagttctggggtacatgtgcacagcgtgcaggtttgttacatatgtatacatctgccatgttggtgtgctgcccccattaactagtcatttacgttaggtgtatctcctaatgttatccttcccctctcccctaccccacgacaggacccagtttgtgatgttccccatcctgtgtccaggtgctctcattgttcaattcccacctatgagtgagaacatgcggtgtttggttttctgtccttgcgatagtttgctcagaatgatcgtttccagcttcatccatgtccctacaaaggacaggaactcatccttttttacggctgcatagtattccatggtgtatatgtgccacattttcttaatccagtgtatcattgatggacttttgggttggtcccaagtctttgctattgtgaatagtgccacaaaaaacatatgtgtgcatgtgtctttatagcagcatgatttataatcctttgggtatatactcagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcttgactttttaatgatcaccattctaactggtgtgagatgatatctcattgtggttttgatttgcatttctctgatgctcagtgatgatcagcattttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagccttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagttctccttgaagaggtccttcacatcccttgtaagttggattcctaggtattttattctctttgaagcaattgtgaatgggaattcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgctcccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgcgtatgttgaaccagccttgcatcccagggatgaaaccaacttgatcatggtggataaactttttgatgtgctgctggattgggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcgtatgtgtcaaggaatttatccatttcttctagattttctagttgatttgcatagaggtttttatagtattctctgatggtagtttgtatttctgagggattggtggtgatatcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttttagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctgagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgactggatccctttaccattacgtaatggccttctttgtctcttctgatctttgttggtttaaagtctgttttatcagagactaggattgcaacccctgcctttttttgtgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttagaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggccccccctctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctaggttggggaagttctcccggataatatcctgcagagtgttttccaacttggttccattctccccgtcactttcaggtacaacaatcagacgtagatttggtcgtttcacatagtcccatatttcttggaggctttgttcatttctttttactcttttttctctaaactgctcttctcacttcatttcattcatttgatcttcaatcactgataccctttattccagttgatcgaaacggctattgacgcttgtgcatgcatcacgtagttctcatgccatggttttcagctccatcaggtcatttaaggtcttctctatgctggttattctagttagccattcatctaatcttttttcaagatttttagcttctttgcgatgggtttgaacatccccctttagcttggggaagtttgttattaccgatcgtctgaagccttcttctctcaactctcaaagtcactctccatccagctttgttctgttgctggtgaggagctgcgttcctttgaaggagaagaggtgctctgatttttagaattttcagcttttctgctctggtttctccccatctttgtgattttatctacctttggtctttgatgatggtgatgtacagatggggtcttggtgtagatgccctttctgtttgttagttttccttctaaccatcaggaccctcagctgcaggtctgttggagtttgctggaggtccactccagaccctgtttgcctgggtatcatcagtggagtctgcagaactgcaaatattgcagaacagcaaatgttacttcctgatcgttcctctggaagcttcgtctcagaggggcacctggccgtatccggtgtcagtcggcccctactgggaggtgtctcccagttaggctactcgggggtcagggacccacttgaggtagtctgtccattctcagatctcaaactctgtgctgggagatccactactctcttcaaagctcagttggaaatgcagaaatcacccgtcttctatgttgctcacgctgggagctgtagactggagctgttcctattcggccatcttggaacctccctcctctcccaaagcgctaggatttgaatgccacaatacatattgattcatgtttttgtccattagtggtccgtgggtatctataaatgaagtctattttagagtccatagatatcagcgttctgcaaaactgtcagggatccgaggctcccagcctacagagcttcttttacttatatgtagtatagatatttaggttcagcaaaacttggttttctgataaaattagatctgttaaggaatgtacccccaaaacttaacatgaaaaaccttttcaaacgacaagtaaacctggcacagtggctcgtgcctttaatcccagctatgggagattgaggcaagaagatcacttgaggccaagaattcaagactagcctgggcaacatagtgagatccttatatcttaaaagaaaaaaaaaataaatttagctgggcacagtggctcacttccaagtagctgtagtcgtagctatttggaaggctgaggtaggaggatcacttgagccaaaaaaaacttctctttttatgtagttagagtgagctataatcatgccactgcactccagcctgggcagcaaagcaagacccctgtctctaaaaaaaaaaaaatatgtaaaagataagtagacagtgacagttttcaaggtggtacttgaaaattcaaacatatagaaattatcatgtgataagatataataattataaaaccataattaacacccttctccatgcttaattgattatatcttccttgtcattttgttccttctttctgtttaattagcaaaatggtgtcttataattctggaacagcaaacaaaatttttcaagtcagcctacttctaacactaaataatttcatattttctctaagtaccttatacctgtgggtccaattttacttctattaataaaggcagaatagatagatttttccagaaggcacttaagtgtctgaattctgcccatggcagagacacaattttatctgaaaaaggttaaagagattaatacttcctcattaaatttccaaataatttatttaagtatatattgccaattttcacataaaattaaagaactttcttttattcccgagaaggcaagtcatgggttgtctcaaacaaaatatgaaaagaacctgggtcaggtatcagtgctcgttcaattaccttggctttcttctttacgtcaagcccaaataattctaaatgttgtgcttaggttttcaaagggcttacgaagaagcaattaaaagctcattcaaatgtagagagcaaacaaattaaaattatataattccatcaacctatctaatgctgagattcatctattcattaattacacaaacatctgttgagggcctataatgtaccacacagtatagcaatatggggatctgcaaatgaataaggcacaatccctaccctcaagaagctcatagtcttctaggggacactaaggagtaattagaaaacaattatgaaagtggattataggcacacaggaatgatagaaccatcaatccaggaacttaattcactctgggatgggagcatggatggggacagtttccttgaaaaagtgacacctccctgggtcttaaagaagcagcagtcaggtaggccaaaagcaaagaaggactgtctagaaccgagcattcagcattcagccagcttgcacggagacaaaaggctaggacacagcatggcacacccacaggaactaaaagcactgctgtgcccaagtggccacttcaaggcaagaatagcaaatgatagacataggaaaataagcactagtcacatcttggaagccactgtaaaccgtgttagggaattggaactttctcctggaattaatggagagctaccaaagaatcttagttagatcagcatcagtgtcagagagaatctaaggatccacagaactggaggcagggaggccaacccagagactactgctgacacccaaatgagagatgttggcagtgggagcagaaataaagagatgggtcagacatggtggctcacacctatcatcccagcacttggggggccaaggtgggtggatcacttcaggccaggagttggagaccagcctgggcaacatgggaaaaccccatctctacaaaaaaaaaaaaaaaaaaaaaaaatacaaaattagccaggtatggtgccatgcgcccgtagtcccagctactctggaggctgagaagtgggaggaccatttgagcccaggaggtcaaggctacagtgagccatgattgcaccactgcattccagcctgggcaacagagcaagaccctgtctcaaaaaaaaaaaaaatctgtccttgccaaaaaataaaaataaaagagagagaaatgaagagattaactttagaaatatttatgaggcaaattaggcaggagttggtgattcaatgtgggcagtgaaaaagaggaaggaatcaagaataacctccaagtttctagcgtgggtgcctaggggattgtgatagccttttcatgttaattgattatatctttcctgtcacttacagcaatctttcttcttcatctaataaaatactttcattatgaaatatgtttcacaaattcaacaagtaagagagcctccatctgcctatttccaatagtttaagactgattttgtattttctgccagtgcctcatagtgggttaaatgctatttctattaataaagataaaatatgtagactagcaaatatagaaggaaaatccagttcaggagggaagatgattattttcagttgggacaccttgagttcaaggcaacttgcagaggtccaaaggtagttgagtatacaagactcaagtgtgggcaaaaatctgggttgtaaacacagatttaagtctcatcaggccacagagggtcactaaagtcatgagaatggtgagactatcctgagagtgtccagaatgagaaaagctgctcagggcagggctctgagcaacaccaatactcaagggctgagtagaagaggaaaataaaatggaatgaccaaagcagctcaaaagagagccaggactgctgggagtcatggcagccaagggagtggtgtcaagaaggaggaatggtctccagagtcaagtgcaatctaaatgcccatccagtgtgagaaggaaggaaaagtgcccattggcaatcaggagttatctggtaactttagtgaatacagaggtggcatattttgtttgtggttaaaagatatctaatggagaatttttatatcattaaaaatgggagaattgcctcatgaaatgtatagtcatttaaaatgatatgcaatattgttttaaaatgactgctataaacttatctccagtctcttttcccaagcagttgcccttagtagttccaatcccctctgtaaagtattattattagcaaagggtcatccaccacacattgaatcgcaaaataaagctcagctttcttcccactctgtgagaggagtaagagaaaatagactcaaaactatatagcctaaagatgaacaacccatcatttatgcatttagtatctatctattaagaacctcctctctgcctgagagaatgtcaggccttcaggatgcaaattttgagacttgagcagcttttatgcaatcaagaaaggccaataggataaatatggcagagcaaaaaagtgagaaaaagctggataatatttctgagctgggaattaatcaaccctggaacaaccctatagttaggcttcttattatgtgagataataaatcccctttttgtttaacttttttgagttgtgttttctttccttgcagccaaaaacatccacaatgatacaagaatgattttaaattatacaaatatccttaatagagaaaggaatggaatgatacatgtgatagacaaattgctcataggtcgccatcttatatttacccaacattacttctcatctaaaattattttcaggccagtcatgggggggtcatgcctataatcccaacattttgggaggccaaggcaggaggatcactttagcccaggattccagaccagcctgggaaacgtaacaagatcgtgtctctacaaaaaatttaaaaattagctgggcatggtggtgcacacctatagtcccagctactcaggaggcttaagcaggaggattacctgagccccggtgtttgaggctgcagtgagctgtgatcgcaccactgcactccagcctgggtgagagagtgagaccctgactctaaaaataataataaaataaaaataaataaaataaaattattgttagacctattaaaacagtcttttccagtctgattccaaagaaattagaatttaaaggttttttccaggttactgaaccaaaccccctcaatgtccagggatgccgcagttgccaagatccgcttcatcgctactattttctttcttgttcaagctctccctatggtggctgtggcagcagtcactgaagtaaccaccaagaagccctccaacaaacctacctacttccactcagtcaaaaagaagagaatttaatattggggcagaaggagtggaaggtttgaatacaaagtatgccacagagccaaaggactcattcagctgtcaaccacacacatgaagacacccagctatacactccaataaatatttggttcctttcttgagcataacataatcaaaattaaagattgggaacctatctcacttccaaattgctggggtatattcataattcttcagtacatccgtactttcaatatcatccaacccctgaatgagattgctggcataggttcccttatgatttaaggccctgctccacatttataaagaatcatcccattgtgtgtaacttctttgcgacaggttgggttttaggtgtccacaaagccaaagcaagattcctctccaaacacttacagcaatcttgacgttcatctgagccatcatcacagtcttgatcttggtcacacacccaggagttggggatgcattgtccctcactctggcacttgaaatagccctgctggcaggtcacaacagctaaaacaaaccaaaagaggactcattatggcaatcatcctccccattatactagcaagcaatgcttgttccagaagagtgtatcatgtaaactcctgctcaatttatttgaaggcaaatagtaaacaacccttatactagagtctgtggacgccagtcagagttcactgtcaaataagctcagcaacagcatcacaacaaactcatgaaccaaagcaacttaaaaacacagagaataaaacaaacagcacacatacacacaaaaaaattatgataaaggtattagattaaaagcttcattcaagtaaacattaactgtgagttactgttaaactatttgtttcataataactaatagtaaagtatcatgatgaactggaaaattcatgagatttgggaaagaaaacccaaaatcaaataattattatttccatgatttacttcctttaagatctttggcaggttctctgaacctcaatgtatgcatcataaaatggggactatactcatctcactgtttgttgtgaaaaataagttaaataatgtatgtgaaagcgccatgtaatgttacttgctatcactatcgtcattgatattgttgttattgttattatttttacaggtcaataaaatataatacaggtaacaatctctgaagagttgttggcatagctgttcacttattcctttaccccagatacactgcccttgcctttttgcttttattgtttaatcaaaatgaactcagtaagcccagaggaggcaaatagttagcacatgattgtgtctctacaaatatagtttagtcccttgttcaaagtgcagtccacaaactagcagcatcaacatcatcaggaagtttatagaaacgcagaagctgaggtcccacctcaaaatatggaatctaaatttgcactttaatgagctcctgggtgatccatttgtgcatgagtatttgaggagcactgtacagaaccccatccttacccttcctcccattttcaaatgcgttgtcatctaaatgacacaccaaagtttgactgctatggtatgccataacatggccaacaattcaaaacaaaaatttttcacctgctttcctgatttttgaaagataaccctcattagttcacctgctgggatgaaggaaattgcagatgtatgattgatcacctatgggaagttgggaagagcaatgggatctgtgcatagacttaccaactgtaagaactttaataaatgacttaacttctccgagtctcaatttactaatctgaaaccgacctcagaagattagtgagaaaactaaatgacaaaatgaatgtgaaagtcattttataattaattagatttgaagtttactacattatcgtatttttcaaattttttaaaactagaatttttaaaaaacataaatcacactaaccaattctgtgatttctttatggtaattgacacaagttattctacatcctttacataaaaatggactcctctttgacttacaaatcacagtagttcagataacattattttttgtttgttcttgtgggtacacaaaatttacagagtgaatattagaaataatcacctacagactccagaaaactgcacccaaatatgtttccatatcaaagttgtggtcaagggataagggtgagatagaaactgatgctctatcatcaatgtgaattgaacccctacctcagaagggagtgaaattattgttaatgccatcagttctctattcaaccacacagatctcaaaagacttgggcccagacctggctctgtcactaaaaggcatagctcttctctttgttacagctgaaatcaccaggaagcacttaggttactcaaaatagaacttagcctggcccctcctcacttaccgcagccaatttcatccgcgtcatctgaacagtctttggtcccatcacacctccagtctgcagggatgcaatgcccacttccacagcgaaaatgcgcactgtcacattctgcaataatagacagaaattttaaaaacttatgccatgcagatatttaaccgaagaaatataaatttttgataaaatgaaaaattattcaactaattagataatcaaagaaatgcaaattagaaaattaggtaaacattctcccaatgataatataaaaatatttatttgaacatccgtgggaagaaagtgattttcatacacagttgattagtgtgtatcttgatggaactcattgggaaagcagtttgacaacacgtatcttgctttttaaaaatacttgatctttaatttagtacttttacttcaaggatttttttcctaaggaactaatcaaagaagtagacaaagatttatgtataaagattttcatcgcaacattatttataacaaaggaagttgcaaacctcctaaatgtccaacaataaaaggattaaatttgtttacatctttatattgacatattagtaacttaaaaaatggttatggagaaattctaagtacttagagaaatacttataatttaatgtaacaaaaacaaggacgtaaatttttactgataacagagttacatatgcaaaaaaaaaaaaagcgtaaaaaagaccagaatgttaacagtggttatctctgattgataacatcgtgagtaacttttcatttgcttgactatactttcttgagttcctcaccttattttttaagtgattttttattactaaatcatatatagcaagttatggcctttcattcttagattcagactaatattttgtcttaatttttaaaaattaaattataacttgccagatctataagctcatctctgcaaacaattttttttaaaccaaagagccaaaaacaaaacaaaacaaaatctctgcagccaacaagagtatacaaacttgacaccaaaagttgacaccccaagtggcagtgatagtccctagtgatactggaaggacaatataacttaaacaagctcacttcactgaactaatatatcctgtgattttcctaggtctccccaagggacaaagttccccaaatacctggccagtgaccttcccaagcattatgtgccacatagaaaaatttttcaaagaaagcagccactaccagccccacttagagaagactcaaaattattttattctttcacaaacccaagggataaaggagaaatttttgcagttggaagaataattatatcttccccatgtatttaagcaatcatgctaaattacccatttcaatttttggctaattaaccaaaattaggtaaatatacagatcaagtacctactcctaaaataaataagcaatgtgctatcctgatttgtgtaaatgcaggcatatcaacagcatgacataaacatagttaagtgatctatttctagggtatataggctactttgttcatggaatgttcaaatctgattgtctggtagtgacatcctgatttataatgtatgctgcaaatggtcagaaacttcgcttggctaaatggtggtaccgagtggtacaggagtacgtacacccaaataccttctatagactaatgcatgatggtggttggtggtgcaggtctggggttggtggtgcaggtctcttatcaactacctttaaaacacaacaacctcccttgcaaaaatgcccctaaggaatgtacaaattcactctggaatcccagaacttctcattggattttgttctacaaagcaatatttccatgggagattaggggctttggaggtttagctattaacacaacatatattaaatcacttttatcaattaggtctattgttagtaatccaacataatacatttgtaagttcagtacatttgtctcccttagtatctgaggttgtaaaggtagtatcttctggttgaaaaattataacaatcataaagaacagtcctcttacagacagtttcatattgctatggagaaaagaaaaatataaatttagagactgagtatttaggaggaaattatcagaacaatatatattgcctgttttgaaaatatatataattaatgctatttcttaagcaacttttattacaagtcccatttttgaggagtggggtggggggatttgtttgtttttgccaaactaaaataccaagttaaacacatcatgaaaagaacacaaaatagagactcaaaagtcattttataaaacacttcaaagtcaattatttaaaatcacacatatgaaaaatgaaactgatggggaaatgttgcaattaactaatttttataggtagtgattttcacacttgatctcctcactccattatctaatatatcaaatccaatttactcaatttatcaacagatctataattcatttgtcaaattcaccttttcagtagtaacttcgatgcctgtttataactcccaaacgactattgtttggaaatatctctccagaaaaaacaaactgatactttatcattgctgggtgacctctcagccatcagccaaaatgcttcactggcctcagaagctcattctctcataaagggaatatgtgttgtttaaaaataaaccaaaaataaaccactagtgaaaaggtctagattaggtctaataacaattgcaggtgccccttacttcaattagtctatatgcaatttattttgagtgttttgttttaaataagtagcctttactcacaagccctccaaaagttttatctagatattatctacattttgttatttatttgaagatttaaaaaaaaaaaaagctaaggggatgatttcatacattggagccacccacagggagaaaaaaaaaatctacatagaaccagctttaaaactttgttcagaaaatagtctcaaaactgccacattcaaccaatccagttttagccaagaagtaatcttgcaaataatcatttatgtaactttaaaacattctccaggagcctctctggtttgggggctgcctgattaaaaaaaaaaaaaaatccctctagtaaaaaccaaggaggaaaggaggaaaatacaatccacattgaaataaaaaccttttgttaagaaccaggcaatcatcacaaaggaaccatcggaaccaaatgaacaccctatctctccagcactagcccctgtctgtcccatcaatcagaatagatggtgcaaagatgaaaagaagtactcatatagcacttaaatggcacacaccattctaagtgctctgccaacattagctcatttaatcctcataataaccctatgaaatagatactgttattatgaatattttacaaataaataaattgaagcacagagcaattcggtaacttgcccaagatccaacagcaaatatgtgcaaagcaaggatttgaatctgacagctctgattccagcattcgtgctacttgaccactactctatgttccctttcaccaaaaaaaaaagtttattccactaaactcaagaatgaatgtaaaaatctgatttttttcccccaaagctgctctcaattaacattaattgagttcattattgggctggcatagaatccatagtgcttatatacttcagttggagaaaaagagtagtttacttggtgactaacatagcattaaaaaattattgggcttaggaaaaattgcagcaattgaaagcaatgcaaaaaaaatttaagcgttttgaaatcggtagtaaaattttattagacataggaataaacttgttttccaacctcataaagagcccaaagctaggggaaaaaaaaaaaaaaagagtaatcctttcttcataagtagccatatcccaagcttcctgggtaagtgttggactaagaatgtgttaagataagatattagagtaacagatagcgcccagagaagaggagtcatttgcctgtttgttttccacagcaaggaacaacactggattgagagcattcctctgtgtcatttacagcctctggcacagcaccgggtgcttatggaatagctaatgcatgttcgtcaggaagtgtagaattctctttgtaaaactcagcctgctgagaccattatatatcagagatatagaaagctatcagagcaaacaatgagactttaaatagaaatttaccatcttaaatccatagaaagaaaaatggaatctggaataatctgaaaaaaggggaatatctagaagtttttttcaaaaaaaaaaaaaaagaaagaaaaaaacattgagtcatattaatagcagtttcattcttttacccgttccttgtaagtttctttctccttccataaattctattcttataagacaaagacaagtggtagtcaatggaacattgtccaaagttaacagagtaaggtaatttctgtggcaaatcctatttccccgctagatcctcttaacacatgctggtccttccaaacacttggtctacctgaggaggtacagtcctctttttaaaaatttgtatgagtaaatcacattttaatagttccaccttcactgaactcaaagaaacaaacaaatttaagaggcaattccttaacttatccataatttttgcttcactttttctatacttaattttgattcctttggtatggatagacatccttctgatattcataagttggctgacagttcactacaattcccataccttgcccacataaacaaggccagtccccttttgaagatttagagtcacctgcttatttccaaaactttacactatagtgatgatagccaagggtaacaaattgtatggagcactctaccctgtctagtgtcaaattgatagaatagtcaaggattcagttaatgaaactgaaacaagacaggaacagcaaaccaacctgctagtctctttctgtgcaacattttaactgtctggttttccttacagatcatcaaataggtggcaggaattcttttgggttttttttttaatccagtttacaaaccactgaatagactgctttgtcccaattattgattcagagccctgatgttttcttagagcaaaacaatactataaggacatttcaagaagtcaaagatttggggacaaaacccacaatgcaaattgatgcattatcatgtagacacatcatttaagtgcaaaaataaatgaataaataaataaggaccaaaagaatatgatgccagattcactaaagccacaaataaattcataactactatatgcaattgtcctaggatcagtggaagaaaaaagaaaaataagatatggtccttttttgctctgcctctccctctccctctccctctccctctccctctccctccccctctcccctctcccctctcccctctcccctctcccctctccctctcggtctccctctccctctctttccacggtctccctctgatgccgagccgaagctggactgtactgctgccatctcggctcactgcaacctccctgcctgattctcctgcctcagcctgccgagtgcctgcgattgcaggcgcgcgccaccacgcctgactggttttcgtacttttttggtggagacggggtttcactgtgttggccgggctggtctccagctcctaaccgcgagtgatccgccagccttggcctcccgaggtgccgggattgcagacggagtctggttcactcagtgctcaatggtgcccaggctggagtacagtggcgtgatctcagctcgctacaacctccatctcccagccgcctgccttggcctcccaaagtgccgagattgcagcctctgcccggccaccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgcctcttcccggcagccatcccatctgggaagtgaggagcgtctctgcccggccgcccatcgtctgagatgtggggagcgcctctgccccgccgccccgtctgggatgtgaggagtgcctctgcccggcggcgaccccgtctgggaggtgaggagcgtctctgcccagccgccccgtctgagaagtgaggagaccctccacccagcatccgccccatctgagaagtgaggagcccctccgcccggcagccaccccgtctgggaagtgaggagcgtctccgcccggcagccgcccagtccgggagggaggtgggggggtcagccccccgcccggccagccgccccatccgggagggaggtgggggggtcagccccccgcccggccagccgccccgtccaggagggaggtgggggggtcagccccccgcctggccagccgccccatccgggagggaggtgggggggtcagccccacgtccgggagggaggtgggggggtcagccccccgcccggccagccgccccgtctgggagggaggtggggtcagccccccgcccggccagccgccccatccgggaggtgaggggcgcctctgcccagccgcccctactgggaagtgaggagcccctctgccgggccagccaccccgtccgggagggaggtggggggatcagcaccccgcccggccagccgccccgtctgggagggaggtgggggggtcagccccccgcccggccagccgccccgtccgggagggaggtggggtcagccccccgcccggccagccgccccatccgggaggtgaggggcgcctctgcccagctgcccctactgggaagtgaggagcccctctgccgggccagccaccccgtccgggagggaggtggggggctcagccccctcccggccagccgacccatccgggagggaggtggggggatcagcaccccgcccggccagccgccccgtccgggagggaggtgggggggtcagccccccgcccggccagccgccccgtctgggaggtgaggggcgcctctgcccggccgcccctactgggaagtgaggagcccctctgcccagccagccgccccgtccgggaagggaggtgggggggtcagccccccgcccggccagccgccccgtccaggagggaggtgggggcgtcagccccccgcccggccagccgccccgtccgggagggaggtgggggggttagccccacgtccgggagggaggtgggggggggtcagccccctgcccggccagccgccccgtccgggagggaggtggggtcagccccccgcccagccagccgccctgtccaggaggtgaggggcgcctctgcccagccgcccctactgggaagtgaggagcccctctgccgggccagccgccccgtccgggagggaggtgggggggtcagcgccccgcccggccagccgccccgtccgggagggaggtgggggggtcagcgccccgcccggccagccgccccgtccgggagggaggtgggggggtcagccccccgcccggccagacgccccgtccgggaggtgaggggcgcctctgcccggccacccctactaggaagtgaggagcccctctgcccagccaccacctcgtctgggaggtgtacccaacagctcattgagaacgggccgggataaaaaaaaaaaaaaaaaaaaaaagaaaaaaaaagaaataaataaataaataaataaaaagatatggtccttttttgacagagcctataagtttattgggggcaaaagtgatttatatgttataaattaaatatccatgcaataacaacagctgatattgtttactgagtacctactatgtgttatacaatatataaagctttatacatatccactggatcctctcagaactgtatgatgtgagatttatacttatttaatagaaggggaacctgagcctcagtgacattaaccaactcccccaagggccacaaaggtagaaaatgtcgaagtctgatttagccccaggacctgtgtgactccagagcctgtacttatttcatcatttcatgtcctgcaaagcaaatgacagcatttgttcacccagaacttgccagcaatattttaagtgcttcccatgcattaccttacatatcctcacaacagctttgtgagatggtatcaatggccccatttcatagatgaggacgacaaggcttgaacaaatctcacagctagtaggtagtggagcacagatttacactgaggcagtctgattccaaagctatgcctctgacaacagacaatttggttccaaataagcaatggagataataaaaactaactgactttggcgaaaaaaataacactacaggccggtgtcatcagagaagtcttcacaaagaattataagactacactgggtctttgtgaatgagcaggatttgggaaggtgaagagggagaccaggctttgtgtgtagggtcaaaacaacttgacaggccaggcgtgatcactcacgcctgtaatcccagcactttgggaggccatgccaggcagatcacttgaggccaggagttcaagaccagcctggccaacatggtgaaacctgtctctaagaaaaaaaagaacaaaaacttgacagaagcttagcatgggtgagggtctaataagtatgacccaagcagtgatgacctcttggagagtggtaggcaacaaggctgagaagatggagaaaaagagctttcagtgccaagccaaagagtgcctgtcaaatgagtatgagggtgattactcagacaataactgcattaaaagtgaagatcactctgagtaggtaaagcctgaactagcatacagactttgaccatgaaaagagcttggagctccacttcaatccccagaacctcaccccaaccctgagcccagtgagcaggctggtaggtgcaggcaagaggctgctagcagagaagggtctcaccttgcagcccctccagctgccccagaagcatccaaagcaggtccgcttgcatggcaaactacgaacaggttccatgagggaggggtccccagtccctgggctacaaactggtactggtccgtggcctgctaggaaccaggctacacagcagcaggtgagaggcgggtgagtgagcattagtgcctgagctccgcctcctgtcagatgagtggctgcattagattcccataggagcacaaaccctgttgtaaactgcacatgagagggatctaggttgtgcattccttatgagaatctaatgcctgataatctgaggtgaaacagtgtcatcccgaaaccatccctcccccaccaccaccctgctgtccatggaaaaattgtcttccacgaaaccagtccctggtgccaaaaagcttggggaccgctgccttagggcattgccaacaacatcctagtgaccagcccccaccatcctctccaagctggatgtttctgagtatccaggccacagaatccagtcagctctcaagatagttgatctcaaagattacttaaatatttgcttagtaattaaaataaagtgcctttccaataaccaaatggcagcagaatgagatgtactacttgagcagcctctcaattctgagcaatgagagatttaaactgagccatttataactgagctacccttctccatttccatttaaacactagtcacctgtctttctcccccaaggctcttacatcccacttgttttttcattatgcacctctcacctctacaatcaggcagtccatcagcactacagaacattataagcaaagccacacttctcagaggttcttcagaggacgctatcgccatttggggtgggacaattactcatcttgcagaactgtcctggtcaaagcagtatgtacatcatccctgacccccacctgtggaacaccagtagtgctcccccacatcacggtgacaaaaacactcccaggcacatctatgccgcttgagagtggcagtaccacccccagtggagaacaactcagaacctctaagcagcttggacagtcagagctcaaaattatcttagcccacatgaaagagatcatctaaaaaaaaaaaacataatacattcttcccttctaaagataataaaatttcttaaacagcaatcccactccttcccacccatcaataagagcacctaggattgggcaatctcacgctgcagctgctagtaccagcaacttgaaatgaactcccctgggagagtgataaagaatctaatttccaggaaggcctgtttcaccctggaatgctccattccatcacacgtccacaggtctaccccttcaaggggaggggaccacactagaaaaacacaagcatctgaaatcctcaagtagttcatcattaatgtaaaggattgtggctatgaaaaacagtcataagcacctctgcgttgtggtgcaaacttttcccgtccgtattcattatcagagcaaaaaaataatttctccaaatgtcctctccccatcccaactgcatacattcacaaaaaattaaaaatataaattgacaatcacttaagcgctcaaacattcaaaagaatgtccaagtttttaccaagaacgctgagcaatgaaaacttcctgttagccagcatcaaagcactgaaagtgtatttgtaccagtcttttctgtgctccccctgaatagctcatgcagtgcctcctctatcagctaagtcactgaggttcctggagaggaaccttccctacacgtggaaggaaactaagctcaagactttcttctcctctggccccaatccccactagagactaactggttatttacatctttcatggtaaaagagctacacttacaggatgttgaaaagaacactatccaaacagaagaaaatttaagatggcctgcctgcccaggtaaataaggacccaatgaatcaaactacttacaagaataacatgcccttcagcacctcatgatttgacacaccctgtgcaaaaactacaaatcattcccatttcagagcacatttccagtcccagtcacccagagaattcctatacggctttttgattagcaatataaattactggaaaatggttgagtggaatcaaacactaaaaaagaaaatggacattcatgagaaataaatgacaagagagactttagaaaggcagctttcttgcttaaggcttttgaatggtgtttcagactagcattgatagacagcatcaaattagggttttcctgattaattaggtccaagtgttgaaccataaatcaaactgacatggatatgttaaagctataaacatcactttcattttggtcatcttaataatcagatgagatcaccaggttatcaagtgaacaatagttggatactgcaaattatgacaatagcaacaagaagagaagaaattgactctcaattggtagatttggtaattccccatagtcataggctaaattatttataactactaaatggaccttcttgactgaatcttataaacaccttgctgtattccttctccctaactccatattatttagttcttgactatcgcaatagtaacaacaagctctaaagaaacgagaagagagagaagaggcaaaaatagggagaaaaagaaaaagggagacagagaaaaagagggcagaaaggagagatgtcaaggttagcaatcagtgtccagacactaaatttcatgagacctagcatcttgcatcctagccttggtttaaatgacacctggcatcttgcaccttaacctcaatttggtacaaaatggcaactcacccttatttagctatggcccaaattcagattgaagcagtatgtaattgctaagtgggtttataagtcacaagttacatgctaggaactaaataacctcccattctaaatgtgtaaattttcagaaagtagagatcaggtatatacatatatatatacacacacatacgtacatgcacatacacatatatatacataatttactctaacgaaaccaatgcttcaacatcaataagcaactctgatgacaactcttatcagaaatgtttatgcttggtgatggtgaggctcattgcattgttattcacacaaacactaaactttattcacagttcattcgttagatgaataactgagttgcacacacaggcatgcctcgaccttgaccatttagtgatgggcatgtatggcttctgccaacagagtaagaattttcttaaactattaagaaatattgtgcagcaagagtgccaaaagatttccaacaataagtttaaaagccttttcttgggcagtaagtactgataattaatcatctagtaaactgaagtcaacatttttaataaaaatgtaatatgtcattctcttttttaaaaactggttttgctgatgttttacacaatatttttgtatttttcccctttagtgacaagttatgccttggaaatgattttataagcagaaagttcaaaattctcctgccacgacctggatatgtgaaatataaggaacagaacagatgagactaagcgacctctgtattcccagggcctgttacaggacctcctagtacccagcctaccctcaataaacgaactatatatgatgtgttagaatatatgtgtgaaactaagatgatgtccaaaagatgacaaagagatctacaaggaaggaaggagggaaggaagaaaaggaaggaaggaaggaacgaaggaaggaaggaagggagggagggagggagggagggggctacaagagtacttcttatcctacaatcaaaaattgtaatttgttttataagcaatttgctaatatagcataatcatgattttaatttccctatagagaaacaaatgtaatgccaaatcattgccttgtaaatctgtaaagaaggacctattatatttgcaaatactctcatggtagaatgaccttaaatttcctgtgtctcccctactggattgcttttaacagactgagcaaaaagaacttcagaacatgcctcaccagcaggttatctttgcaccaggagtcctttggccctggtttgttatgcctgggctcaaatagcatgaggaggtctccaaaccactttcaggctctgtcaatgttatcacttcacgttataatgtgattgtgatgacttgaaacaattcaatagcttgttgacacagaatcaacaatattacattgtcaccaactgatacccacgtgtgataaagtggtgttcaggtttctgcacagacatgatgaatttataatgtccccatattaatagcaacatgaataaaattacaagtttatctgcagtgattgccagaaatggaaggaaaaaaagcagggtatatttcctaagattttgcctaatctgtgttttaaatatcattagtaattacagtaaaaacctttgtcactattataaatataaaattttagaattttaatgctaaaaagaagtacggcttcagtaataaactataccagaaaatatatacaataaaatctctactaactgacacacaaataattaaagccatttgcttactggagttttgtttgtattatacttcttacaaaggcaattaaagaaaataaaatgatattagagtgttggtcaagaatagagttttcagtggccatctcaattctgggtgttgggtacctatagttacagtcttggatgagtatgagtgagctaatatgcagaacatggatccataggcattataataattaagtaaaatttaaattaaattcagtaagaatggctaaaataagaataccaatggaaaaagcaatcgccagaaagccaagagatgcatggctttcaactctggcaaagcactgactgtccctgtgtcattccaaactctaagttccatgagggcaggaactgtttgtgtctcatttaccactgaaccttcactcaataaatatttgttactgaactggtttagcttgatgaacctgaatttaaactgatacagtatgcagttttcttacctacaaaatttctgacctgcaaaatcaggttacggtgaggattaaagaggtccctgtaaacctctggcacaatgcctgaagcacagccgtccctccatgaagggtggttccttccagggcattcccactactcatctaattctaacattctaagagttgttcccctactatctgactgagagaaaactttcaaaatctaagccaccttgcttggtaggatgctcaacactgaaagcacagatggtggtggttgcctccactggcccagtcttcggtcaagggcaagagtgaaaatcaagatttattctgagaaacacaggtcaaactagagtcaaaagcaagcttgctcccaacttgctattttcttgtttatgcatttttatgtttattttcttgtttatatatttttgtattttcctacgatgagcatttttattattttgtccattgtaaatcattcatatttcaggtgatcctctggagttttacatgaaatactgtaggtgtataattccatcaccaaaaagaaattgatgataaacatacaggctttcccagaattgaccttaagtcattatactgtacattaaacttggacatcgttatctttctatcatcataaaaggatttctgttgacctcaactcatgccttggcataagccatagaattaaggacataaagaaattgaggattaatcaactgaaaccaagctaaaaagttttccattcaaaaagtttggccagcacagtagcccatgcctgtaaccccagcactttgggaggccatagcaggaggatctcttaagctcaggagtctgtaatcagcatagacagcagagagaaattctgtctcaatagaagaaaaaaaaaggaagttcagcgattctccaggacccacgtttaaaagaatttcaaatttttcctaaaagcatgaaaggccaggtgtggtggattactcccgtaatcccagcactttgggaggccaaggtgggtggatcacttgaagtcaggagttcaagaccagcctggccagcatggcaaaaccccatccctactaaaaatacaaaaaattagccaggcatggtggcatgcacctgtagtcccagctacttgggaggctgagctgggagaatctcctgaacccaggaggcagaagttgcagtgagccaagatagtgccattgcactccagcctgggtgactaagtgagacttcatctcaaaaaaaaaaaaaaaacaagcattaaaagtattcactatcctaattctctaaactttctcttatataacagaagaatgcaataaatgcaaaaatattatttgactaaaataacatacaataatgcctttctaattcattcaaagaaaaactttattatcttaagttgttaccctatttctgtttgaatgagaatagatttccataaacctagacatccagcccctgcaaacgaaggaatgaggccaggcgcagtggctcatgcctgtaatcccagcactttgggaggctgaggcagttggatcactggaggtcaggagttcaacaccagcctgggcaacatggtgaaaccccatctgtactgaaaatacaaaaaaattagccaggcgcggtggcatgcacctgtaatcccagctactcaggaggctgaggcaggagaatcacttgaaaccaggaggcagaggctgcagtgagctgagattggactactacaccccagcctgggtgacagagcaagactccatcacacacacacacacacacacacacacacgcacagaggaatgaaataccccattgccatgaccccactcctattcttttccagtaatgaaacagagagaccttaccaccctccaaagtattctccactgcacagagcaaacactccaaactaaatgcaacgcaacaaacaggtactgaagctctggtagaccatttatctttgtattcttaaggcagaataacacttgtcaggaaacaagccctcttgtccacaaccgtttggctatcctcaagcaagccaataaaactatcccatctccttccagaaaccaagaaactaaagtcagccagttcttccctgggaagagttatgttcactctgtttactataagcactcaacacttcacaaagtttggtgggtaaggttacaaagagggaaaagcaacttaaacttaaaaggctgttctgatagtccaggaatgagacgattagagccttatctagttaaatggtcccacctccgcctgacttcccccaccgctgtctaaaaatcctctccttctctctccctcagatccccatgacatggccagagtttccatggctcacgaccctgaccccaaaaatctgctcccaggtgaacttattcacgggaaggtttgagagattcttaaagccttctacgggtgtttgcactttcagcagaaaacagaagccctccaaggaatgaattttctaattgtggcattttaggcattcctaatgcctacataccttcctcactggcttgatggagcagattgtaggggaacagagtatcttatcagggctcctaacatcgtaccacataggttgtggtaccatgtataaggccatctttgctaatgccagaaacctcatcagcagtgagatagcatttttccataaaagcacaggccagcccaaatacagtcaaagggcttttcaggagaatttggtgacatctctggatcagtgcaatgtattttagattaatctggactgaagaaaaaggccctaaggaaatattgcaaaaacaatgactccaaaggcctcaagagaatccattaacacgtgaacatgattaatgaaacactcatgtgggttctgtttaaactgaaagcccttattctactatttgtaactcaaagaactccttccactggaaacaaaagattcatccattccacccaaagtggaatatatgtgtatgcatgcatgtacatctacatatatgcacacaagacagcccaatattaccaggcttactgatcaagaaacagacttgaggccaggtaaggtagctcacgcctataatcccaacactttgggaggctgaggcaggaggatcgcttgagcccaggagtttgagaccaccctgggcaacatagtgagagccagtatctacaaaaacaaaacaaattaaccaggtgtgatggtgcacacctgtagtcctagctattcaggaggctgaggtgggaggatcgcttgcgcccgggagtttgaagctacagtgagctatgatcatgccactgcactgcactccagcctgactgacagagcaaacccagagcaaaagaaagagaaaaagaaatggggggaagtagggaaggaggaagagagggagtaggggaggagaggaaagaaagaaagagagaaagaaaagaaagaaaagaaaggaagaaggaaggaaggagggaagggaagggaagggagaaagaaaaacaaagaaagaaagagaaagaaagaaagaaaaaaggaaggaagaaagaaagaaagatagaatgtaagagagacagagaaagaaagaaggaaagaaagaaggaaagaaagaaagaaagaaagaaagaaagaaagaaagaaagaaagaaagaaaagaaaagaaaagaaaaaaggaggaagacggagggaggaaaggaaggaaggaaggaaggaaaaagacaagacaagacaatatgcattccagaaggcatgctttatagagtgctcatttggccatgtgtttgtttaccatcactggattaactcaagaagtttcaataaatttgtccacctattgattcaactactgttacatatgaaatcattatttctccaagtataacagtctgtattttccttcttccattctgcccagcatgtctaaaagtcaacagcttttccacagaaggttaagagacaaagtctgaatagccagatgctgcatactactgggaaactactataatattacagaagggcaaggaaggggaagagcacgcgaagactgcttagaagccaagtaactgtccagggtgaagtccttctagtcatatactagggattcaaaccactgctccacctcttactaactatctgacagccattttaatttctgtgcctcagtttcctcatctaaaaacggagataataagagctcttactcataacattaatatgagggtagagtgaggattatgggtctggcatatcagtaagtgtttaataaaaattgattactgatactatttttaggccagtgttttctgatcctttaaactccaaatattgtctccctctcaattctacagggttttttttttgcttcttatatatttgcttatatgagagtttatgtatatatatagctcttctatattcatcatctgcaacccagtttgaaaatctattaaaataacctaattatgtagctaattcccccaaaagctaatttaatacagaaatttgagtattttattattacttttattttacattattacttctcttcccaactaaatctttctgatgtctaagattcacaaaacaacaacatatccatattcaaagtaaaactgaactagaaaaataaaacttaattcacaaagtcaagtttataggcacacatctattccacatgcgttcaaaaatatatcactacttagtgaaataaattaactctttgctaaattatttctctggttgatactagctgtgtttttaagacattttcaacaattatatttcaagggtgtttaagaaatttagtaataattaaaaaatacatgcttaactaaataacactaaccagttgcctaaacatagctatcttaatccaaagaagttgatagtgacaatatttattgaatcactgagttgtacaatatagaattactaacccctgttattagtatctacaattttaaaattctcctcacttcactctgataaatttggaaattgtttctgacttgatgatattttgaaaaacgccaagcatgggggaaacatagagaccacatctcacaaaaggaaaagtccaaagcttttcaaaatgcagactgctaagggtgttatcaccatagcaaccctcagtaaagagaattccaatatgaagtaaccagagaataagcaatattttaacctcaaaagcacaaacttatggatacatctatatggtatgcatctgtactatataaggtcaaaggttaaaagtgaccctaaagtcaaattccagcattcttttggtgcatacgatatatctacaatttctttcccatctcttagagtcatttagagtaagttttatccttcttcatataatagttcctcaaatatttggagagctaaccattgttcccctattctcttgtccaaaagaaacatctccagtttttccatcattcccccataatattgtttccagttttctcatcattcttgtttctctctttcaaataaggttcaaattttctatgcctctcccaaaatgtggtattcaaagctgaagagaagatgtgcagtgtcacccgaccagctttggccaggagcagtcatggcatactttaacattcatttgcctctctctcctcagtaatagaacccagtgttactcaggtgaactatgtgctgagctaaaaagctacattttccaaacttcagccaaatgtgatcataggactaagtcttaatcgatgagatcaaatgcaagcagtagtgttgtgtgggacttctggaaagtctcctttaaacagagaaggcatgtcctcctttctccttctgcaatcccactacctggcatagagaaaggatggctatggctacagcagccattttggacaatgaggtgacttcaggaatgggagtcaccagcagaggactgtggagcctgtgtctctaatggtatcatggaaccaccagaccagccttccactgctggttatgtaagagagaattaaatgtttgtcttgttcaagccaaacaaaatcctctctgcgacaggagcccagagtagagcatgcctattacctccccaccatgatggagttgctttactataacacatgctgttcttttgactttctattaaacaaaaatttcttgagtgcatgcttatgcctgacactgtgccagacacaagagaccagaggagctaggcatactcttagcatcagtggtcctgttctatgcctctcccaaaaggtggtactcttctagaggaagagataaaatacatacacaaatgattgtatctcatggcatgaggagacatgctgtaagagaggttcagataacattcagtggatatcaagaaaggtcctgtagagaaaggtgcatttaagctacagatagatggatctgaggggaggggacgcctcacagaggaaacaaactagaactggcacagaaacagggaagtgcaaggcatgtccaagaaaaagtcacattcttcatcaatgtcactggcacgtcttcaaattacaaagatcatacgtgaggcagattctcttttatgtgaagtaaaaaaaaattaaaattaaaattaaaataaatttgcaagatctttgacaccctctaaagacactaagtgcctccagagtcaattcaattccccaggcatttatggagcaccaactgtttttccatcaaataagagtttcttccaatctacaaaggcatcctaattttaaaaaaatttcatcaaatattttccatatttttaaaaatgcttggaggcgataacttgtcaatattctactaaactggcagaaatgtttccaggaggtatattctgatatttaacaaactgtaaagcacaaagcaagtgtggttctccttttcctcttattattaatttaaagttacaagaaagtaaagcatgtggaaaaacagagtattagagttaagtatgtgaggcccagagccaaatatcctactctgcctcagttcactcattagtaaaaagggaatagtaatggtatctacctccctggagtgtcacaagaacaaatgctatagctatggtgactatatatcaggcatataataagtttcagtgtatgaccgctcttattaccaatagcatccctttctgcctctctattcacttcctatcaaccaagatgggccctcaacaaaagaactattggcatttaagcccagacaattctttgtagtatggaactatcctgtgtattgcaacggtttagcattcctgtcctctgccctctaaatgctggcagggatactcaggcattgtgacaatcaaaaaatgctactatatgtttccaaaggttccctgagggagatgaaccaactaggaatcagtgaactaaaacaaagaaaatgtcacacgctatgcccagacagacagcaagctggaaatttttcaggcaggaaaattaaaaaaaaaaaaaaagttgaatatttatgaatgtaattaacatacacatacattgaaaagacatgtctaatattcccataaataaaacatgccaacttataaaacaaataacaagaattatcaaaaacggcaacaaataaaagctttctctttgttccatggtgactctctccttttctcatcacttccaagtgcacaagtctagttctaccctcatcatctgtcacccagataatcccagtaatcctctaacttaactagttcatctgctttctctcattgcagcaagtattctttttacaaaatgaaaatctgagcattgtacttcccagcttacatttcttcaaaggcaccaaacttcttagcttgacatacaaaatcctccacagtccactctcccaactccttcaagactcagttcaaatggcaatctgtgcggtcttccttggcccttggtcctctcaggtctagttgactacatcactgccttttctgtgctcccaaacttctattatagacctctcaccctgtagcacaattgtttatttgcatgtcttattcatctatgcatgtcagttcctgataaaaaaaaagcttgcaataaacgtgtgtgaaagaaatacatcagtgattattttaactgtaattattaaccaagtctagcttgacagctttctcacctattgaacatctcactgacctttctgtagtttcatgaaataataaggaacttttgcaagagagaaaactcttcattgactgtgattcttacatgctctgtctaaaacctctcacaaaatcaagtgctcctcttcaagtgtagtcttccctgggcaaatccttctccttgcccagaggacacatctgacctccactcagacccatgcttccatcattcctgttctcagagttacagagacatcatcagcaagttctgcataaaaccaagttacagaaagcatgcacaggacacctaaaatggaaacaccaggtccaccaacgtttgaacttcttggcaactttacatttggatctgtgccttcaagacctgggaggtgaagaaccaaacattcttgggggaagaaaggcaggtgaccaggcctgtcttccaacatttttttgtctagtagtttcatctgctttaaaaagctgtatttttccccagcaatttctatggatagagaatttgacaagtggtttctttatttcaaaaaatcacagcatggtggctgctttgctgcatgacctaaccaagagctggtcaactatgaatgatttaatatcaggttccctgtggggccaaatgtttactgaatgctcaccaagtgccaggaccttgcatgttcacaatatcctttaaatattcccaggtacctataaggtagaaattactaacacccattgtatagtccaggaaactgaagctcagagagcttcagaggtacacatctggaaagcagtcgagctaaatctctgagctgtgattccagaccatgtcccagtaccagaaagggtttggccacaggttaactatgtccagggaagttgggaaggggtagttggggtatggccagaaagcttctataataataggaagagcccagaattttgcttggcagccagtgatttaaatttacaacagtggcttcagctcagtttcacaatttaatctatccttaataccttaaaggaagccatagaaattttctctttataaaatgtgagaatagcatagaatttttgcaaatacataaatatttactaactcctcaaaagttattcaagatgccaaatatcccttcttgaagaaaccataaataaacctatatcatctgtcctacagtgaaaatcctcagagaatgcaatggcatattcaggggcataggatatggttttataattttccagctcatatttctttctttttttattattattatactttaagttctggggtacatgtgcagaacgtgcaggtttgttacataagcatgcacatgccatggtggtttgctgcacccatcaacccgtcatctacactaggtatttctcctaatgctatccctcccctagccccccaacccccagcaggccccagtgtgtgatgctcccctccctgtgtccatgtgttctcattgttcaactcccacttatgagtgagaacctgtgatgtttggttttctgttcttgtgttagtttatccagctcatatttcattggagacaaagacataataaagttatgtaagcagggaagagaattttcaattataaagattctaaaaagtaacaacattttagttgtatatttgtatggtatttttaatgcaatcaagctttacaaatgaatgcagtcaatatatcccaatattttgtgaaattccctctaaatagagcatgtaagacatccattaaagtttatttttagctaagagccaaaccctgtttcattttattatatccctcatcgagttttaacttagaaaacataaataaaacaagacattaagtgacttaataataaaagcttatcctagagtgtgtttcaggattgctttctacacccacccccaactactgctctcactaaatcattctttccaaatgtgctgagatgaaggagcaaaggtgtccttaagcctgacttttccttaaaaccatatattaaaagtttccctggtgtgctcctctcaaactaaaactggcttatgattaagagcaagagtggcaggcagtgactgagatgagaaggaaacactctaatttgtcatcaaaaaaataaatcagaaaatagcctttaatcttaagagtacaatttactgatttagtcatttatttacaaaattgatggaaattgttaacaaggagttaattgatttaagtcacctgattaccacagttaattaaccacactgacttaatcttctttgaaaacatcaactaatcatttcccaggtgtcaaggggtaaatcgttaaataaaaaataaacctctgtcctcctcttcaagagagatttcttgagtgtgttttctttacggattccaatctagccacaagccaagtttggggaaattttgttcttatatgactatactgaaagagctgccttctttccagaattttttctccgttatagtaaaggaaaggcagccttgcaagcttaccgtgagtgtcattttgaattacttcaaaaatgagcaaggaacactgcgtaaataaaaatgaacaaataaaaggcaacagagacattcatctgggaaggtcagttttcaaaaaaggaacttaaaacacactttattgggagggtgtggccacaaaggagtagcacaagggagttagtgggggtgattgaactgttctaatcccgaatgaggttgtggctacacaaatatatacatgcactaacatttacagaactgtgcacacacacagcaattttagcctatgttaatttttaaaattaaagcacttcataaaggccgattctcttttttacagatagaaaaatggaggtttgaccccttggccccacctcaaaaggaaaagagggggcggtcaaaaaaaaaaaaaaaaacgagcactgttagagaaactcagaaaaacatcctacatgactcttgtcgttcttgttctgagttagcagaaccactgcttctctccaaaaacaaaacaaaacaaaacaaaacaaaagtcaattgtctttgatccaccaatgtgcccatagaacaggaaggccctggagggaatcaaagtcccaggtcactgtgacaagtcacacttagacctcctaaagggaagaagtaactacagctttaataaaactccatcctcttcctatccctttctccttccttcaatcacagcaaaatgcttgaaaaataaatctggattacagtgggattttgttgcacatattcacaatcagcaacaactattaaagacccttttgatttcccttacagggaaacgaaagtgttcaatacaatatgatccttcttagcccaagtccctcttggtgccatgttctctcgtctgcactgttgggtttaattatttacagcaagaagcatctaacttccactgtctttcagttagtatgttcaatttttaaaccatgcattttgtttttcactagaatcttagctttcaatgattacttagcaaattctttcaacacttcactgaaccaaatattagggaagaagtaaattcttatatcagaagtgaccttgaaaaaaaaatgcagaattttggtacataaaaaccaatcatttgacaattgacttgggacatgtgtatattcaattttatgcatttgcaaattctttttttattacacagtaactttaaagaaaaacagagctaggcacagtggcacacaccttagtcccagctattcaggaggctgaggcaggagggttacttgagcctaggagtttgaatccagcctgggcaacatagtgagacccccatctctaaatttttttaaaaatagaaaaacaggattccctattaatagtaatcattatggtctagacaaattataactgccatgtatattaaaatccaagggtctcttctcaaacttaccaggcactgatgaatccccaaggaatggttgatggagtcttgcaactgtgttgcttttaacgacaacttttccttttgttgtaacaactcagtttcaattgctaactagaggaaggacagccatactagaagcttttaagttctatctttgaggccttcctaatagatcacagctgaaattccccataaagccattctaagaaaaagcacaagcataataaccctttattccccagaaaaggaagttggcttattttcaagactatatcacacctctagtaccttctttccctctttcatccccattaaaacataccagctttgtgtctccttctctctgaaccttgctctgacaaacatttactgtgcattactatctcaactaactactttaccctacaggagtgaacatttccacattgtaataggagtttcaggaggaaagaatgtcttactccgaagaactgactttagtaatgacagagcagagatctttggccgtagtgagagatactttgggaccaagagacctttaagcacatccagcacataggaaatgtcttctccatctctacaacagcagtgttctccgggaagtaaagaaactcagctctcacttggttgttcatttttttcttcagtgactttaaataagagaacttaataatttttttcattagtagtaaacaacaacaacctctgaaaatttatagatgactgctgtccctaacggaaggttaaaattgaactctctgattaggtaagggtcctttgaattaaaagacacataattatagagggaaaaaaaaaaaaggtgttcccagataatgaaatagtaatataggagaaacccagcagagagaaatcaatccgtacctaaaaagtacagtcttctagtcttctagaaggaagtggaaatatactctgttcaatagtaagttgttttggatgtggcctatgttgaaggtctctgtctatactctgcagtacctagttacatcacgcctagagcatgataaggctgcaacatatattgaatgaatgaatgaatgaatgaactgccaagagtagcaaaaaaatgtccaaaagttgggtcgcaatggtaccagcctctgaaatgaggtcatctgatcataatatgagaaattaaatgaggcttcatttgattacgtacagaggactatcttccacttgctccaaattatccatggtgacaacatatacaaataagggttctgggttcaaatgttggctctgccacttagtaactgaattgctttgggcaaattacctcacctgtcattgtcttggtcctttatccataaaatttttactgttactacataagtaggtaaactaatacctacaaaacacttaggccaatgcctggtatagaaagcactcaaataatttagtcacttttattgtggcttatttcccaacttctctactcatctatgtgtggaattccatcattctcctgcctccaacctatttgttacgtatggagtcctcaaaagaatggggactgagatgagggagactatgcccaggagacaagtggccatgggtccttttcagcagtcaggggccctcttcgtctgtgcccatttttccttcattcatcaggaacaagacccatgaatgtcctgacttgacatgtgatgttctttccaccacaatccatgctgcctccctgagtggagaaaccactcccctcttcaaagagggccttttgtttgatcaaggctgttttcactgtgtcatggtctcagacagctttcttttgtgttctgtttaaatacagaatgacagtccactaacacgaagtctaaaaactttggcttatctttttgtaaaagctactgtatcaaatctgtcctaaaaatagcagaatgacccattctgtatgtacaggggaattctcacagggtaaccaagtatctgggatggaagttaaaaagaaggatgcagattcaactactcaaatgcattgggaatcaccagcagggcgggagtgggaggcactggggtggagaaaaggggggagtcagatcgagagaaacagcgttgctaagccacttgctttgatagagacagcaattttcctttttctccatcaggaccttgactgggcctccaggggcctcgaggaattaagggctggtagtaccagggaatggtgatgagctgaggatgccccttcttagcacccatggtgacatctgtccattcatttattcaatgtatattcatttatttagcccttttctggacactagggaaagcaatggataaaagagatgaaaatccctgcccttgtgccatttacatcttagggaagggaagataataagtaaggaaataaacaaacaactaactaagttacataccttatgtcagatggtggtaagcgcaatggagaaagtaaatcaggaaagaagaggtcgggaaagaatcagagaaggccacactgagagggtgacctatgagcaaagacctgtaggaggaaaggaagtaagtcatgcaccatctgaggcaagagcatttaggaaaaaggggggcaagtgcaaaggcccaaaagtgctcaccatgtcagggaaaacaaggatatcactgtgcctggtgcactgtgcatggggagaggagaaggaaatgaggtcagggaggtgatgtgaaggccaaatggttagggtcttgtagatcatagtaaggacttggactttgactcttcatgagatgggaagcagtggtacacccagagttgtgccatgcagcttccccttataggaaggaccagctatgaggaaggactttcttcctgcaatcagctcctttggggtctgcctcagctatagaaagccacctgcccaaggtcgtgtccttccaggacaggccacatccagtgattaagcaaggccatttcagcctgacataggacactctaacaggcaactcttgctccagagcttcctctgggttgaccaacagctgccagagttcaacttcttcttctgcccatcctgcttcctccctttcccttcacacgcattgatcttaataaatattatatactccaagctccatctcagtgtctgtttttgggcaacccaacttgagtatgacagaaaccatgggagcttctgagcagaggggtgctgtgatctgactgatgttctaaaaaagttgctacagcaaggaaatcagtatggaagccattgcaatcgtcgaggcaagagagggcagtcggttgaatcagggtggcagaagtgaagatggtgaaaagtagttggattctagatgtattttgaagatcaaaacaatgggattttctaaggaattctatatggggtagaggagcaaaagaaaagtcaaagtaggatacagtttgaggcttgagcaaggatgaggaagccatttgctgagatgagaaattccacatggaaagcaagtttggacattagtggagatcaggagttcaatttcagacatgtgaagtctgagatgactattggccagccaggtggacatgtcaaatgagcagttggatatgtgggtctagactatagggtagtggtctggattagattcataaatttgaaagttgtcagcatgtacatggtaaagaagtatatatggagtcctcaaaagtatggggactgaggccaggcacagtggttcatgcctgtaatttgagaggccgagggaggaggatgacttgaggtcaggagtttgagaccagcctgaccagcatggcaaaaccccatctctacaaaaatacaaaaattagccaggcatggtggtgtgcacctgtaatcccagtttacttgggaggctgaggcaggagaatcgcttgaacctgggaggcagaggttgcagtgagccaagatcacgcctctgcactccagcctgggtgacagagcgagactccatcgcaaaaaaaaaaaaaaaaaaaaaaagtggggactcagatgacagagactatccccagaggacaagtggccctgggtccttttcagcagcctggggccctctttggttgtgcctatttttccttctttcttcaggaacaagatccatgaatgtcctgacttgacatgtgatgttctttccaccagagtccatgccgcctccctgaattgggaaaccactccctgcttcaaagagggccatgagacaggatgaggccaccaaggaggcagtgtagctagagatgaaaacaggtcagggatatagacaggaacaagcatgagataccaagggtaggccagcaaggaagaaaagaaaccaggagaaggcagtttcttgaaaatctaactaagtgtttcaaggaggaagtcaggatacactgtgtgtgatgctgctaaccagttaaataaggaccagagctgaaaatagatcattggatttaacaacatggaagtcatgagtgactttgaccaaaaaaatatctatcaaggatgagggctaaagcaaaatggcatggatttgagaaaaaattgaaaggtaattacagtggatataggcacatctgtacaagaattttactgtaaagtggaaccgaaaaaatagagtgatagttagaaggtaatgtggaacagaggatttcataaaagaaagaggggacaattgcagagaggtgagagggaatgagatctagaacatgaatgaaatggttggacttaagaactgggaaaattcttccagagtaataggaggaaagacagaagatataagacgaagttcaaatgatgatggttgagttatagaagtttatggaattctcttctggttgcttccattttcacagttttaaaaagctcactctacatgtgagaaggtgatgtcagaggtttgaggaaagaggagaagatataaggaagcaagagaggcaatagacagactaggaagcaagtcctaagcttgagattggcttcatgaatgtcaagcgaggctagtcagtatagttgtgtttttctcctgccatgtttagctacagagttgcagatgtggagaactggatttaaccaggatcagggccttgccaagcacaacagagccagataaaggggccaagctgctgagcgcgtatgtatgcagggaagtgaaattaatgatggccataaaatataagctgaggaagtaaataggtgagggatttgagggatggtgaagaggcggtaggatcaacaaactgtaagtcccaatgaggtcaacaaagagttgaggctgggatacaaaggaaatgagccatgaagtttttcaatacttccattccaagcatggaacagacagcttctctagaagccagtgggctgtgtcaggggtgttctgagatgaattcagattcaggtgagaaaagattagaagacctgcaacagttatttacctcaatgaatccaacgttcttaggagggtctggggggaacttcaaaggtgaccaaggtaagaacaaaacatacaattaagacacaaacagtggcatatttagggagaggttcaggacctgccatgctggccaaaaaaggaggtggccaggaatgagggtagtacttcatgtcaccctcagacttaaaagagtcctgtccttcttgttgtagctagcttgtaacattcccatccaaaagaaagagatttaacagagtatatttaactgccactgaagaaatttgcagtggtaagtcagttcacctctaagtctgtttacaaaactgaaaaatgagagggtacctagatcacacgttcccaaaaattggtccagccctcagaatcaccttgaaacttttaaaaatacagattttccacattttctttatctagtctatcactgatgggcatttgggttggttgtggcacatatgcaccatggaataatatgcagccataaaaaggaatgagttcatgtcatttgcagggacatgaatgacgctggaagccatcattctcagcaaactaacataggaacagaaaaccaaacaccgcatgttctcactcataagtgggagatgaacaatgagaacacatggtcacaggggggggaacatcacacacagagaggggaacatcacacaccggggcctgtcagggggtgggggccaagggaagggagagcattaggacaaatacctaatgcatgtgagccttaaaacctagatgaaaggttgataggtacagcaaaccaccatggcacatgtatacctatgtaacaaacctgcacattctgcatatgtatcccagaactgaaagtaaaataaaataaaatttttaaaaaacacagattttcatacccctgctttagtaagggtgagttttgatttaagaatctctatacttttttaagttcctcaggtgattttgatgatatgtcaagtttggggagctagctgactttgtctagggtccttagaaattctaacaatctgtaagttattgtgatgaaataatacttttgagaacataactaaaaccttctcaaagttggattccccctggataggatcaaggaaacacgtagccccatttgccctggcagccatatcagaatcatatgggaagccagaccgcacacaaaggtgaaacttaggggggagtagggtcaaggaaaacacaaagaaagagaactggagccctgactgcacctcgcctgaaccccactctgcctcagtattttttactcacataagccaagaaataccctttattgtgtaggccattttgagttgggttttctgtttcttgcaacaaaaagtattctccacacccttccccacatcaaaattaaaccagtgtggaagtacatgctagcatgtatcaccccccttctagtgagattaaaatgtgggtaggattgccatatttctgataaaatactttcattcttaaattcaactttaagaatttcctgacaaaataaatgatttcagccgggcatggtggctagcgcctataatcccagcactttgggaagctgaggcgggaggatcacttgagctcaggggtttgaggccagcctgaacaacatggagaaacctcatctctacaaaaaatataaaaattaactgtgagtgctggtatgtgtctgtagtcccagcttcttgtggggttaagcggagaggatctcttcagcctgggaagttgaggctgcagggagccatgcactccagcctgagtgataaagtgagaccctctctggcctgggtgataaagtaagaccttgtctcaaaaaataaaaataaacgattttgattttttcaacctttactcaggaaattttctccttgttaatgacataaaaaccaaagaactgggcccaaagtgacaagcaaatcactgacagtataagacagaatatttttatagaggaatccaagaatgtccagcataacagaagtgtagctactttccttttcgtctttttcaggtttcctcaacaccttcaaaagtacacatgctcttacttaatgtgaatcagtagatcagtgaggaaagacttattttcaaagttaccaggaatcttcatgtgttattcgctgatagtacataaatttaaaggagaccttggatattgcttacaaacttggatctcaagatctggacaataaatgcgccattgtatccatggtaacagtggctcaactattcaatgcacagaatggtaattacatttcctcctttcattcatttctcactgtttccagtaaccttgaggtcaggcatgacctgagggctaatgaccaaaagtgaaacttcaaattgtctaatctgtcattatctaggaaagacttacatttctttgcactgaatttcagtgctatcctaaatcagaagtgtcctaatataaaagttaaccatcttatttttagaatgataatgtctccattttctcagctaatgtgattagagataagacttaaattagagaccaacaaagtaaccatcagcaaagagtacatatatctggcatttctgaattaatccaataaggtgtgatggatacgtgttctaccatttatgaaagaagtccatagatgaagtgctaaggacactcagatgtgcaccaagatgtgttctgtctccacagaagcatcttaacctgtctgcaaactctttaagcttctttctctctaccccatccttatagcaaaggactagtgcttggaaaacagacaaactcttaggaacataaacattggagtgaagtaaattggaaaaggagtaggagcctaagattcacagaaaaatgaaatactgcaccagacttaagggatcctgtagtctgatcgctcagctcattttccagaactttcctgtctatcacaaagctctgctccaaataagaaaactttaggatccaaataaaccttctaaaagtccttctttctcctgttctccttctaaacttaaagttgcaacatggtcacatgggcacagatcaccatgtcttttttcttaatgtttccaatactttattcctttcaattctgtaagttaccccagggctgccagctcttgagaaatttctgtagctttttcaagtgtgtcttcacatacaaaatgaaaataacatcgtcagtcaattttatctgataaggtatactgaacacctgttatttttgcatcccagcctctgttcaccattctcccaataattacccccatttctctctggactccaccccttcatacatgatctcaaagactgagtatacagcccaagcctaagccatgggaacacatcatgacccgggattcagtggttggttctccaatgagtttatgacctaagtagagaccctgagatgcaactgaaacttttgctgggaatagctaagataaaaactctttttctttcccagtggatgtgatctgataggaggtggctccagagccactgacagccgctttacatcaaaggagaacatgtttaagaatggagtcatctcagagccaggagacggaaaaaagacaagattggcctgacatagtttgagcctccattttatattaggttgaaccaaatgaaattgccaatatttgactatttctgcataggaaaaaaaatcaatctcaaatggatcaacctaattatctgtatcttttcaactatgtatttattttctttgagacagggtctcactctgtcgctgaggctggagtgcagtggcatgatcacagctcactgtagcctcgacctcctgggctcaagcgatcatctcacctcagcctcccaagtagctgggaccacaagggcacaccaccattcctggctaattttttgtattttttgtagagatggagtctcactatgttgcccaggctggtctcaaactcctaggctcaagcaatccgctcacctcagactcccaaagtgctgagatttataggcatgagccaccacacccagcctcaactatgtatttcaataaccttccttttttgcctcagacagtttaacttagttttgtgacattcaccaacataacagtactgaataacatgtgaagttgtggtagccactgtaaggatgtaacaacatgcacaggtgcatcattctcagacccacggtaaagaagataccaaaatactgcaacatcttcctcctctcaagtttggaaaaagtaaaattctcgtattgggtaataatgatgaatggaaatctatatgagacttcacagtttattaaacatttcacattcattgcctttgcataaccaccccgtgaggtagatatatgtccattttacagataagaaaactgccccagagcacccagcatgtgtggtactggatttcccagataataaatggcagaggtaggaatcaaaccaagatcctccaacttcaaaatcacaagcccttcccacttcatctcaaaacactgtaactgtcaagaaattacttcggaaacatttgcattaggaacatgtgaagaaccacagaaatgctcttgacatttcaaaacaactactagctgatcattatcaagaagcatcccagaactcggatgctgaaacatctccaatctttctaatgctggtgagatcctgggcagggttattaggaatgagtcaatgactatttcagaatcttaaatgcaaaactgcagtccattttaattgcgagatatgtagacacctcttttcagttctcatcttccttaatgtttctgtagtattgatactattgactcatcagcacactgttgatatttaataaatattcatggaaaaaataaaataaacattcacagaatacacaatagtggtaaaaatttttaattactcaagactataaagttaataggatacgatagaaccatttgatttataccaaaggttccatcaagcttattttttccatgctagaatagggcttcacaattagtatttttttagttgctctagattcgtgcagtcaaccttgagaacccctttcctatccattcaacactctttcataagcaccttctactttcttttcttttttttttcttttttatttatttttattttattttattttattttattttattttattttattttattttattttatttttgagacagattcttgctctgtcacccaggctggagtgcagtggcacaatctcagctcactgcaatccctgcctcctgtgttcaagcagttctcctgcctcagcctcccgagtagctgggattacaggtgtgcgtcaccacgcccagctaatttttgtgttttaaatagaaacagggtttcaccatgttggccaggcaggtctcgatctcctgacctcatgatcctcccgcctcagcatcccaaagtgctgggattacaggcatgagcccccacgcccagctcagcaccttctactttctacttaccttgttctagctactaggacttaacagaaactccaaagccaatatgacaatgcacttgcttctgattacacaggaaatacatctaggttcctggtatcattatttttaaatgataatttaaaattttaatttaaatattttaaaaacctttcagtgttcttacagtgcctgactagagaacatgaacaatgattatgacctaataattacctttagtaagactgaaaacctagtcttacagcagcctgcactacaaaacccaaagatcttcaggaatgcgctttgatggctcaagaatttgaaaaatggatctggaggtatggtctttgggagtaggggcactgacatggcatcagttctggaccaagctgaaagcgcatggtacatggttgtaataacctatcacaggattcctctttggccagggacaggtaacccatccaattgtttttaagattcatctgcttatcagactgtgccttatctggcaagtcaggattccaaaaggaatctagaaatctcaaccaaccaaacaggctggggacattcagaaggcatgaatctaaaaaatggtccactgcaaatttatatcttagctctgtcacaggctagatgtccttaggcaagaaacctattaaccgccttccctttcatcctctcagcccctttcttctccctcctgggctaattgcttatctgtaagaaaaaaaaaatgcaagcagaccagttgatatctaaggttccctctagctgtaaaaagtctgagtttctattaaaatgagacaggtgcatgactgaagggagttcaggcagaagtcttatgaagactggtaaagagaaactttttcaagtagagaaagagaagccaacaactgtgaaattaaagcagcagtgaggttccagagttgtgatggaataaaaacgatacaagtttgctattgcccccacaatccttttaaacatataaacttcatgtgaagatgtaattgtcataaaagctgatactaactcttaaaaacattaccacatttttattggattaaagaatataatgttggaccaggtaaggtggctcctgcctataatgtcagcactttgggaagcagaggtaggaggatcatttgaggccaagagttcaagaccagcctgggcaacacagtgagaccccatttctatttttgaaaaataagtttttttaattagtaaacagaatacaactttgtttaaggccaatacgattttctcaaaaaaaaaaaaaaaaaagaaaaaatcttccaatcacatgctagggtctgagaagtcttcagagaactgttagtgaaaaatgcttaaagaagactttcctttgtatatttgaaaattggaaatggaaataggaataggaagcaaaacaatatgttactttaagggttgataaatataataaaaatattgtatttttagattattttctagtttattttcactgtctatatgctttacaccatgctaagcacttggcatattttatctctttatgcttacaagatgtcattgggtaaattctcttattatcttgtcaattttgcagataagccatctgagctatgcaaagttggttgactttcccaaggtcacacagctagaaagtggtaaagccaatgttggaacccaacagcttgactcgagttcagactctgcaaaatgttttttcttgaaaagcattacacaaaagataaggaaaatgcaaataatttttaacaacagatgtggtataatttttttcaaagactaaacatagaatactcagagctcttttttttcccctccaatttttagtgatgcgaagtttgcaatggtagcctacctaaaaggtagtgcttaaataaaggctgttacaatctcattggattttacttcatatattaagtcaggatcattacaacaggattctagaaatctcaacgtatcaggcagaggacattcagaggaaatgcgtcttaaaatgatcaagtaggaagactgggaatggggagacttgggttctggtcttagaaacctgaggagagattctggaaaaagatccacagttatgaagcagcaggtggtacgagttgcatattgcccctcagcttctttgggaacctcaaacatggacagtaagttagggagcatgacattttttgtacaaaagaaaaaagagaaatcgggccaggtgcagtggctcacacctgtaatcctagcactttgggaggcctaggcgggcagatcacttgaggtcaggagttcaagactggcctggccaacatagcaaaaccctgcctctactaaaaatacaaaatattagctgggcatggtgccccgggcttgtagtcccagctacttgggaggctgaggtgtgaggatcgcttgaacctgggaggcagaggttgcagtgagccgagattgcaccactgcactccagcctgggtgacagagcgagattctgtctctctcaaaaaaaaaaaaaaaaaaaagagagagagagagagagaaaaccagacactgtatactgtagcaattatagactctgaattcagaatcccttgagtttgccattttctagcagtatgaactgagacaaattactgaattgttctgtgcctccactttctcatctgtaaaacagtgataataagagtacttacttccaagggatattatgaagattaattgagtcaataagtataaagtgcttagaacaaagcctgccacatatatgtgtatgctaggttactattactatacacattattattatatattattatcatagaatggaagatggatgggtgcaaaaaactatcaagaagagtaggtattggttatttagtgactaaatcatcaacccaggaaaaagaatatctgttttggttgtacaaggacatagatgaatcaaggtaagatttccttttgccaggcactgacaggaacatatagtaaatcctatagctatatttaggacatgagatacaaccctaagcattgtgcaaactctgcacaataataataaaccctctttctgcgttaccaacactgagaaagggtgttcaaaggaaggttattaatgatctctccttgcctctcctgcctttctgaagacttttgcaagacctgtggggtttgttagggtttccaaacttcttcccaggaagtctgaaatgggtgctgctaggagttgctgtataattacttacttgattccctctaaggagcttacgctaagaattgaggaaagaaagcagattaaccatttgaatacatgccacggcccatccacaagccctcccctcactcctccgtaaatgggggcttccacattccccacccatcaaccccaatatgtgatccaggaaaatcaatttattgctttggctaatcctacaacaataggggtttcattttcattgtagggcaattaagttgtccgacgggagggaaggagcaggaggggaaaggggggactctcccatccccacagacagattagtccctgcggtggcagcagcgtcccctctgtctgtctggtggtcggtcacacgcagctcccggctgctacctagcaacgcaaagccagggggagagctcgccggttccagcctcctcctcgcccttcccattcatcctcggccgggtctctgtctctctgtctctctctgtctctctctgtctctctctgtctctctctctctctctctctctctccctctctctctctctctctgtctctctcctctctctcctctctctctctcttctcccgccccagtcgttctcttccctccttctttccttattcctatttgcttctcttacgctctctcctcttcccttcttactagttttattctctccgcttctttctccctctctttccctcttctctgtttctgttaaaacataaactatcggacaacttgagagaagtttaaagcacttcatactagaaactttctgcattcgatccccaaaactctggccatgcagacgggccccattcatcaacacaaaagcccccagctcccagctggaaaggaaaacttcaagaaaagactccagtccctcagccactctctcggccaatcccacctcccggccttatcttggctcgtaaatgatctgtatggtgagagcggtctctgggggtcaccgcgggaccaagtttcgccggtggtgggaggagtgctctggcccgcggccctgggcgcgcgaagggatcccgggaggggcgctgcaggtggaaagctgcgctctgagcagagcccgggaccgcgccgcccagcagagaactccgctagggagggcaggctgcaaacggcggagaacctcgttctcccgcaaagtgctttccaggagcatcggaccaacgcccgtgggaacaaagacagggtctccgtggggtgcgctgtcaccgaaactggcggggctgctttctcaagtttgctgccgctcagttcctggcgagcgaagaggggcgctcccgctccggcttcgcgaagcaacctgagcgccccaccgggagcagctcccgcgccgccgcccggccctagcccctgcccggacgctctcccctccggcctcccgcggacccgaccctgccacagccggggaagtgggggctccacgagaggctctggctgggctcttaccttggccactggccggcgctaggcaggcgacgagagccaggagcagcgtgcacgccactgctgccggcccgcgatccatctccgcgacggtccccggcctcgccgttccttccccgggaggtgggcgcgcgtagcacaccgcaccggcagcgcctctgctagcgaacgctcctttaggtctgcacctccgccagctcctagtggccaaaagcctgcccccacgcccgaggcatcccgttttctacccgcgccagtccccaccctccagacagtgcataaagccctttagacc

SEQ ID NO: 2549 - DNA, 144275 bp, Homo sapiens
agcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttcttttcctgcctatcttttcactgtgctcctaaattttacatctctttattctcaagggttcaacctttgaagaaggggagcaaaataaatgaaagtggctaaaattttttctttaacccctagactctttcctgttgtgcattaattacatgcttgagtttttagaataattataataaagtaaaactaccaatttaattgtattgtaactgtgcaagatgggaaccttctctcttagagagataagcttttaattgaatagattaatggatcaattgttacctctgctttgctgccagagattctatttaatcacagaagttccatgtagtgctggagagctcagttgcctgaatctttttgcaaagcgtttactgatactgttgcttcaccaaccaaaacaaacaggttttttccttgagtcagctttgtaggtacagagatgagtttggcatcctatgtgacttttttttttttttttttttttttttttaccaccagaagctgttcagaatgttattttcttaaatagttcggaaaaaagtcttgatgtattctatgaaagcacaaaaatagtcagtttctatgacagctggattgtcaacgtctgttcagcttacgtggaggaggatgtcctacttgagtagtataggtagaaatagctatcagaaattgccgcctttgaaagcaatttgaaattatgtaaaaggaagtaatgacaaaataaagcaatttatgtttaatctggaaaagatccaaaagtaatattgtaaagagatcttgagtaatcatttttatcttcctaaaatagccgttgtttactcccgtaagcgagtaagaaacttgtgccattattccttattgggtgcatatagatttctcaccttgtcattcaactccttgcaatattcaactttacttatgcatccagccttatcccaaaatagcctcttccctgtagcagcttccttatcatgtagcagcctactctcctcaccgctcatccgttcttatacaatctggcttaagctctacctcttcatattatattcttctctgagtaatttcaactcacactgagtcttactttcagtatttctattatattggtatttattacacatcacacttagatacttttccattagtctctagagggtacatatatgcactttctctttttttttttttttttgaccatgtcaagtatagttctatagtataatagaatgaattggagatcctttacatttagagagggaggagtctacagtaggaagaataggttaattttcatctccggtttgaaatcaggactttcaatttttttttcagaggtaaagagcaacttagtcaagttggcatcttgtaaacagactgagtgaagatatacttaaaatgcatctataatttcatattttatttcgaaatgtgaaagagcctactaggggtgtctgtgatctctagaccttatcaattcattctagagaaatctggagggagccattgaggagttctacctcctgtctattttatagagctctttctctttttctcctatcagatgtagattcaattgctaaaaatgccacgtttcttgcctctattattctagcttcattacttggggagcagccattctgataacttacattttgctactaaaatctccaacttcacctaatccttcattataagccacttcattttttcctataattaaaattttaaatatgtggaggaaattctgtcaggtagatatgacttaaaacctactaagggccaggtgcagaggctcacgcctgtaatcccagcactttgagaggccaagtcaggaggattgcttgagcccaggagcttgagaccagcctgggcaacagagcgagacccctgtcttcacaaaaaaaaaaaaaaaaaaattagctgggtgtggtggcacatacctgtagtcccagctacttgggaggctgaagtgggtggatcacctaaggacaggagttctaggctgcagtgatctatgattgcaccattgcactccagcctgggtgacagagtgagaccctatctcaaaaacaaaaacaaaaccaaaaaaaaaaaaaaaacaagaaaaaaaaagtactaaggatctggtatagccattcttgcacttaataatcttggtacaacctctaaaactattttttatagtttattttattttgccttatttagacaattggcatgtctatgttcttcataatttagaaattatatgtatttatatatataaattatatatattatatattatgtataaattaaattatatatatatataatatatatatatttgaaatggattcttgctctgtcatccaggctagagtgcagtggcacaatcttggctcactgcaccctctgcctcctgggttcaagcgattctccttcctcagcctcccgagtagctgagattacaggcgcccatcaccatgcctggctaatttttgtatttttagtagagactgggtttcaccatcttggccacattggtctcaaactgccggctgaaatgttgtattttttgtatgtctttctggtatgatttttggagaaaggtgtatcctaagaatacggcttgcttttgtttctgggtaagcattttagggtatcattttgttgtataaccattgtttacaagtgagataagcatctattccactaagattgaagagattcatgtttgactgagtatgctctattaacattctttaaaacatgtgaatatatgtctttcttgttttcaggtgggttggtcacttctgtgcaaattaatagaagtctgtccaggtacaatgcaaagcttaatgggaccccaggatgttggaaatgattgggaagtccttggtgttcaccagtaagtatgatagatatgtaaaacaaatggccttgagtatttatttgtacacatgacaaccttcccttgatacactgtgtttgcaatccaaggctactcctgtggaattctttaaaatacagatatttttccttgagtcaatgatttacatttatagagagctttaaactcagaagtttgatttagaaagcaaacatttaaggtaacatgtcagaagttattattttaataatataatcatataattataaaactggttaagttgtagatttttgatgagtacttttgaattcaaaccatgaagagattttggcttttaataatagaatcgatacaaaccactagttcttaaaaaaatgggaactgagaaaagttagttctgtaagtagtaatttgaaagttgatgttctactgtctttaaatagtacatttatatatatattcctatatatacagtaagtttaaactatggctttcagaaagagttaagaaagaggaaattaactttcagcacatctgtagccaaatcttgatagtaattttaccagctatgtttttgcagtttgcagcataatggcttcttagatgagactacttccttagccatcattaattaagaaaatattttctcaagaagaatgtgtttccaggaaaatacattttggatagctttgtttcttgacagttaaaaaatatcttctaagctactgaggaggctgaggaaggagaatcacttgaacctgggaggcggaggttgcagtgagcggaggttgcagtgagccgagattgcaccactgcactccagcctgggtgacagagcgacactctgtctcaaaaacaaacaaacaaacaaaccttttgtcattaactttaaatcttttttatacctaatatgacttttctttatcacagaaaaggaaattgtgaatattttttggcttccaatggtatatggtttatgaaaatttaatttatgaaaaattttcaggtgtttgtattgctgatcagtgtcaagtagtgctataaatttagacaaattagagctatgtgtttgtccataagtgaacatgtctgtgcttatacattttcccctctttgacaaatgtgttgctcttcttgttttcagtacataaagggtgtgttttggaaagagcatatttacaattaattggagttctcgtcttcaatctaatctctgtaattctatgtatcagttctaaagtatacagcatttgatgaggaattactcaaaatataccagtaattaggaattgtaactttaaatgtcccttggtttgggtgataatttccaggaagtccaaagatgagccagtctataacctcagggagtgtttgggaaactcatctagtcatattcctgtacaaaccaactgttcaaattaaattacataaaagtttatgtaggaaatttcattcactcactcacttactcattcactcactttgttcatccagtcattcatcttctattcattgaatgtttttgaagcctgtcctctgggtcagaaaccatgcagttgtgaagaagatagacacactgctgtctccagtggagtgtattagatcactcccagcaaaaattgattgtaaaacagatttctcttttttcaaggccttttccctccaaagacttaccagtactgaagaaaaatttcttccgtggtaataaagtcaggaattgtgggaatggtatagggagaggtaggggcagggtgattaggaggaaggctggcagagaatcgaagactggcttcattcaggtcctccaattgccaaatggagattatgcaacgtttcttgaatacatacaaaactctagatgtggccagctcagtcttcttccaataatgtaaagccaaacaatgctttgcaggaatagactagagattatattttgggattaataacatagggattaaaatcttatcttgaactaactaaacattattgatatgctaaattcactttttttttttttttttttttttttttttagacagagtctttctctgttgccaggctggcgtgcagtggcgtgatctcggctcactgtaacctctgtgtcccgggttcaagtgattctcctgcctcagcctctcgagtagctgggactgcaggagtacgccaccacgcccagctaatttttgtatttttagtagagacagggtttcatcatgttggccaggatggtcttgatctattgacctcatgatccccccgcctcggcgtcccaaagtgctgagattacaggcgtgagcaacggccaccggcccactactttttaatatatcattaatttctcttttaaaaacagtagcaatcaataatttaaatattcaaatgaattcttaatttatatacacaaactaacatctttattatatctctatattttaatatatcaacatgtctaagataatttataaatttacatcatatataaaaatgggtttgctctcgatgtatataaggcttcatgatattttgaatatggagttgggtgaaaatagtgaatctgaatatttgaatttgaatatttattggaaaataagtagtgcttttaactttttaaatgagacacataatagtcccctgttgatttttttttatttttttaactttattaaagtatagttgacaattaaaaattgtttatatttaaggtatacaattgatgatttgacatgtgtacattgtgaattattcaccacaatcaagctaattaacattccctgttagtttttataagcctggttcaggtttgtagaaagaaacaaacacacatggccaggcacggtggctcacacctataatcccagactttgggaggccaaggcaggaggatcacttgaacccagaagtttagaccagcctaggcaaaatagcaaaccctgtctctccaaaaaagaatgaaaaaattagcctggtgtggtggcatgtacctgtatccctagcaactcaggaggctgaggcaggaggattgctcacttgagcccaggagtttgaggtttcagtgagctatgattgcaccattgcattccagcctgggtgacacagcaagaccctgtctctaaaagcaggcaacaaaaacacatgagcttcactacagggaattaaatacaatgagagtaataaaaaataggtgagcaaaaaaaatgcaaataagcaaacttttgagtatgatatttcattcttatcttgatttctgtttttaactccagattgattcttaaaatgctaacagttcataatgccagtgtaaacttgtcagtgattggactgaagaccttagatctcctcctaacttcaggtaatatgtgtatatgttttttgtgttgattcaaattaaaaaaaaagttgataccattaagtaaatgtgtgtgtgtgtgtttttttttttttttttttgaagatcaggattagggtagcttgatttaaatgtcctaaaattgcatctgtttttagacctagtgatgggacagccataatataatctaaatatcagttatttccaaaattctttctgtttccatctcttctccttatctcttttctctatactttgcctctcaaaaatctcattcaatacattggttttaaacattaccttatatattatccccaaatctctgttggtagtccgatgtttgctcccaaaatctggacctacatctcatattcccccaggttagtggtcattcctgcccttgccattattacttctttctccctatatatctttaataaattttctataatatatgttctggagtatgccataatcgttacattttgaaaacacatagtattacttcttgagtatttgctagatgccaggcttcacaagtaaaatgcttcacgtgcttttaaacacctgaatctgaaaacaccccttgagatagggattttatctcagttttctaagtgacaaacactgaagtgcagagaagttgctttggccactaagaggtagaaacagggtctgattctccatgtcaggttccttccctgagaaaactttggcctggtagataatggacctgaaaacaaaaaatcttgaaatgatgcaacagttgtgggcattgctgtgctggacactggctattatataaggttccgagaagaaaggccgctcacagggagctaatcttgaagggctgggaggagtttccttccatgtaggggagggctttttaggttgagagaagtatgggtgcagaggcctgggaggatagcatgagagaggctggacgtgtgattgggaaggtttgaattgtcctcatcagtcctgctaagagatgtaaagaccatgctggagaaagaggaagatgagagtatgagggaaaaacaagaaggtactcaacatttcactacagctttttatgaccatgttgtatggcatgcactaagagtctttaaccatgatttaatttaacctcacccttgggaggtattttttttttgacggagattcattctccatttggcgatggacaggaagatgagggtttattaatatgaaaaatctaccaacactggaatatattgaagttagcctcatacagtactactactcctattccagtattattatttttattgacagaatagatgctgtttgtgttaagttttggattatgataggaaatgtttggtatagtaaaaggcaagagtgtgacatgcagttagtccaagtacgaagagataccaaaaaaaaaatgtttagtgaggagcagagtttagcatatttggagtgaagacaatgtgcggaaggaaaggagctgatgagatacatgtactatagtcggttgtgtgaaaggtcttgtttttcatactaaggatcatgagaagatcttagtagattccagcaagggatttgcaagaccacatttgtgttttagaaatataatgcaggcaataaaccagttggatagaaattggggactgtagagcaattaagcaactgtttttgcattctagatgagaatgcaaaacacaataggaatgaaggtgccttgttcaaaaggagttttgttcaaaaggaatcttcaagatgtgtaggagatattcttaaaggacttggtaatgaattgatttgttgcttggatagagaatgagaagagaaaggagggtggaagaaggaagatgacttaggagtttctcttgggtagctagtggattatggtatcattgatgaagacagggaacaggagtaggccaggtttggggtaactgtggaatattcagatgttgtctaagaggcataagaatgtatttcagatgtttggggcaagttgtctaggctagaagtactgattgagactcatgaaattatagtaaagtgaactgggagtttatctcatttataaagatctagagcttgataagtctaacatctagggcagttaagtagtttatcaacaaacaaacaaacaaacaaacaagaaaaccatgggtctacaaaccattcacagtcttcatgtaaaaattaattcatgtaaaaattaacacattaaatgttaaagcagctctttactcagagcatattattctctttaaaataggtaaaatcaccttgctgatattggatgaagaaagtgatattttcatgttaatttttgatgccatgcactcatttccagccaatgatgaagtccagaaacttggatgcaaagctttacatgtgctgtttgagagaggtattttaaaatgtcaaattccttaaagtatatataagaaaaaaaggcttatactgggaaaagtagaacacagttataataagaagaaggtttctaaaatcctactatttattaagaagtgggagttgtctgtcaagggtgaggaatggggttaattcagaagtattgcttgttttggtggggtgaatttcattcgtgggttataaatcatgcccctggagtagactttcttcaattgcttaacaaggcataaggtttactttgaaaactggatgtgtgggtgctatgaaagaaaaaataaaactgtgaagccaagcataggttacactgggattatgatgttgagtcatcaccagaaatcatagaaattgcataaagagcctgaaggtttacaaagtgtccttcaggaaaaagactaatatgcatttcatagcctggccctgagattgataactgagattattatgtaattttagagttggttggagtccttgtttagtctttccattgaccttaggaggaagtgggtcacagcagtgaagtgagcatcctgcctgaggacacagagcttgtgacagtacagttcaattagcaattattttaagagccccttttgtatcattatgagagccaactgtgctaggggtttagataagaatgatttatgtgggccctgtgtcagttatcagtttaccagtctaatttcttgcagttcccagaatgggatagatcacctgataactgttgaattccctgtctcctcccagaaggattttaaacagcttatagataattataatacacaagagtaaacaaaatggatgagaaaataggtgaagggacaataatataaagctagattaagtttactgtgtttctaaggtcctgcatatttacaaaggggtgggccagaaatttgtctgtttgcttcctatctgacaaagaaaagaggtaaatatcagtggttacaaagttccttaagataaaagtaaacctattattcaggagaagcaattggtctcatgggagatctgagaaacatcttcccatgggttttcctggatgagacaataaaggacatacattttgcaaggaatacaaagtgtattgcagcgagagtgactctgtcaaaagtcagaatagcatgggcctggtacccagctctttgataatcatacaccgtgaagtagaagatagtttacagcgagtacggaattccttcaggctgtcatgtataaatgttctatcttgcaactaagctttcgatgacaattaggataaagtttgaggttctattgtcttgcagggtctgtaatcttctgtgtggaaggttaggggcacattcttcttcctggaaggagggctagcatcactttatcaccatcgttgtttagtccatctaagacactggaggtagaccatagaatgttacaaagaagaatgttgctcaatagaaaaaccatcagtgctgagagggttatgactataaatgtagagtagaaaaatttctgatttttccaggagtatcaggttctccaggactcaggggtgactataaagttaattttcaaaatttgaaagtgtactgtggaaactagaccataaagtgagaaagttccatgatattcttcacttgttaggaaaacttaactgatttcacattatattatagggacactctggcataaaattaaaaaaaatgaatgttgatcacttagagtgctgtgttttctaacatatttctggcgccattctcaagctagataaactataattttatacatgtttttcaggttgttgcccaataacaatgactccaaatggaacttactggcttgatcaaatgactttaattgtgaaaattaatgatttatatttttgctgtctgatggaaaaccactaagacagagtatttcaaagtctgattacttgccatttgctcaagttgacaactcttgaactgaaacatttagccgagctgcccttcagcagcctaccattaatgcctcccttttaaatattgcaatatgtccagttccagttggccatctttattagtcactgtcagttttctctagaatttcccaaatgaaattgtaaataattttgtttttctgagaactgcttgctgactagcacttttacatttcaaaacatggagtacctaacataggccgaaacaaaattatttgaatctccgtagcttgttttctcattataacattcttaggaagggctgcttcacagaaatatattttttatttaaggagattacacttgatgtatctcacacaactataatgaatattgtaatttttgaataattaaactttcatatcatctttaagcttattcagtattttgtctttcatttttaagtctcagaggagcaactgactgaatttgttgagaacaaagattatatgatattgttaagtgcgttaacaaattttaaagatgaagaggaaattgtgcttcatgtgctgcattgtttacattccctagcgattccttgtaagtagcatttaaatgttatttattttttgtatctgaaaaattacaatatatctcattctgagtatattttaacaatatttttattatttagaaacttgtggatgctcaacccattcattcatttattcatttaattaatttacattcactgacattatactgaagttggctgtgggcttggtgctggagaaacaatcgtggaaaatacagatgtgttccttaccttttcagagcttgtagtacaatgggggacacagataagtacagaggtgattacagtggcagaagtgatggcagatggcagaagtacctagagttaggagatcaaataggaagtgaggcagtgtctcttagcaaagatttaataagtggagcttcctgtgcatgaaggtgtgacctgaagtgagaatgcaggcaaagtggcccaggcagtgggcatggttaatgtaaagatgctggagcaagagagagcagactgccttcaagaagacaaaagtagctcagtaaaggtgtggggttatgagtgtgcgtgcatgcatgcgtgtgtgccgctgtgcatgcacatccccaaatatcctatccgtttgtgtttcattgacagaggcaagggagagcttgataagaggcagtaaatgaggccagagacatggagtggagagcatgaagggcctaaaaagccacatgaaggagtttgaattttattgtgactcttgattagcattttaatgaggctttgaaatttagccacatttttcaccaaaaatattaatcagaagaaattaatttgatgtgtatgctaccaatgattgctattaggctaaaataatggttcatattctgttttgttttgtattaatggttcatattctgttttgttttgtaagtgaccattaacactttgtattttatgtattacttgtgtgggtttctacaggatatacatatgcatttatctagtgatattttcatcctcacacatgtgaagttttgaggattagagttaaacaatgtacctggtatgtaataagtgttctaaaatcactgacaggattattagacaatatgtattttatatgtgtgttgtatactatatgtaattgcatttatggtttcagatatggaaatcactgtgtcaatctgaaggtgtgagccttcggtgtaggcagagtaaaacccaatgcccttgtgaaagaatgcttttttttggtgatgtttataaaatcacaatgttttcttatccacaggaaattaaacactggaaagtgggtggggctgaacaataatagagaaaggccatggttttacatttctctgagacatcactgccaacaaactgaatatgtttttcattatactttttccttggctatatttattcatttatttatttattttgggctggaggtttttggaatccattgttttccacccacattggacataactccagtaaaaatgtgttgattcataatgcaaaagtcaagaaagtagcagctaaaaattaagaaatcaaaagtttttaaaacactgattctaactgaaaaacatttgcttttcagtctttaagtctattgttctgagtcaaagcagttcatttccttacgttgttaattttttttctatgtttaagcattgtaatatactttttgtgaaaacagttgattagttttggttgtgccaaaacaaatactaaaatgttttgcaaacagcctttttttaaacaaaaaaagaacagttaacatttgatgcagagatatacatgttttctccatgtaggttcacacctcacttcctttattgattaattgctttttctggtagagtctttctttcctttctgttttacctgtgtttgtccctaagacttatattttaatattatgcctcctctctttcgttctcccatcttttcttccacctattttggagccttcaggaagcttgattttgctgccttgtacattggttgcccttctggaatggaggaaacaggtcatagctgattttaactgttccatctggtgacatattcttgattttctttcttttggttggggaaaaaaaaacaatgcaaaagtcattctccaatggggttgagcctcgttaagaaatagaccctccacaatggttgaactagtttacagtcccaccaacagtgtaaaagtgttcctatttctccacatcaaaaaaaaaaaaaggtaagcaatataacatgagccatatctaataggacttcagaaattatctatcctatagttccaggatgacgatgatgatggttgtgataatgatgaagattgtgatgatagttatatgggagataaaactttaagcactttacatattaaattctataatattcaccacatctattaaaatatgttacattattgtccctattttaccaacaagaaaactgaccaacaagattaaacaacgtgactaagttcacacaacctgtaacagcagaatctatgtcaatcacaacacaattagcagctatttctgtggcaattttcaataaagatgtgtctggaaaaaaaaaaaagaaatagaccctccaatttatttatctgaaaacttatgaccaatacattacatttccagactttcattttcagtacttttcctttcattttcagtactaaaagtactctgaatttttcctttttttgatcttaaggctttaagccaagaaacaggaataaagtaaattttccttaatgccaaagattagtcctacaccccattatgttattaatgaacagcatagtattttttacagctacttaaagaacatgatgtttaaatttggaaatgcagtcattatgctgccatctatttacagtctatataagacgtctttgtatgcatatttgaaaggagaacatggttaccttattgataattatgatctctttaaattcaggcaataatgtggaagtcctcatgagtggcaatgtcaggtgttataatattgtggtggaagctatgaaagcattccctatgagtgaaagaattcaagaagtgagttgctgtttgctccataggcttacattaggtgagtttcttagttaatatgtcatcacacactgtatgatatacatatacatataaaacatatatatgttgcataataatggataagtagcatattgacatactttgaatgaaaatattgtaaaatcccagaaaaaataaattaaaacaaaaagaaaatactgtaaattaccaaactgttctgctgtgcttagatggacttttaaaaggagtgtcaaaaatagatgtgtagaatgtaaaagaagtattatcttaatcttatttttatagatgtagttctatagatgagtttttttattgttgaggctatatttaaaatataattatgtaagaattgatacatacaaaaatatgcataacatatacaatataaagcataatgcaaataactcactatccaacttaaatgttgtatattcccagtgggggaagctaccctgggcttcttcctgcccttgctttctctatagaggttaacactatccagaattttgtgtttacaaatcttttgtttataaatatgatttactacattttcatgtttctctaagcaaaattgttaatgtttgcctgcttttgcttcatcaaaatgtaatcatactgtatgttgtcttctgcaattttcaaatatcagtgctatgattataagaatcagaaatatttttgcatgtggttgcatgtagtattctattatttggaaataccacaatttatttttccatttttctatccatggacatttggattctttcttattttatgctactactatctgtgttaaaacagataactgaaaaagaacagttaacatttggtgcagagatatacatattttctccatatataaataagggttaatattttaaaaaatatttatttgccattggtatgtccttctttgtgaaatatgcaatctgtcatttatcaatattgttcacaggatagtctgtctttttaaaaccgattcatagattctggataataatgttttggtggtaggttatacgtattgaaaataccttcccttgaacatcacactctggggactgttgtggggtggggggaggggggagggatagcattgggagatatacctaatgctagatgacgagttagtgggtgcagcgcaccaacatggcacatgtatacatatgtaactaacctgaacattgtacacatgtaccctaaaacttaaagtataataataattttaaaaaaaaggagatgaagaggtagctgcaggttgactgagcaagggtcattgtctatttgaagtttcaaaggtatctctgaaaataaacacagttttttgcaagagtgaaaaaaaaaaaaaaaagaaaataccttcccttgacttgtagcatgtcttttcaccgtctttatggtggcttttgtgatatagttaaatttaataatcagttcctttgtgatttactcttttttatgtatcttgtttaagaaatcttaatctgtcctttccctaagataataaatatattgtatattttattccaaatcttactcgtttgttaaactgttgcagtttgtttttgtaaagaacccaattccccctctttttttcagtgtggagagctagttaccatcacagcacaatttattagaggttcacctgtttcccagtcatgtggtatataaatatgtaaacatatatgcttatgtttctgtccttggcgttctgttgcattaatctgatttgtctgaatcagatttaaatctgatgttaaatataacactatttaaattaatagttctgtaagtcctgatatctgaaaagctaataggtcaagtcaccatacattcttttttaggcacagcttgccttttttcttgggcctttactattccatgcaaattacaggattaacttgtccagttccttggaaaacactgttgagattttgactggaattgcacaaaatatgtggatcattttaagaagaactgacatctttacattataatttcttctatacatgtcttgcacatcttagtttttgctacgtatcttattttttattattattgtaaatggtatttctttttaaatcatatttttgaactgtgttttcataaagaaatgcaaatgattttttgtatattgaactaacctacctttctaaactcttcgttaattctgacaatttgtttctaaatgcacttaagttctctacctagcaattatataatttgtaaataatgacagtctgagttcttcctttctgcttcttatattctttatttcatttccttgtcttcttacatgagtcagaattattaatatagtgttaaatagagccattgatactagacatccttgtcttgctctttttcctgattttaaacagaatatttttaatattctcccatccaaaataatgcatcttacaagggtttaaacttttaaaaaaaattttgttaagaaattttattttatttcttctttgcttttgttttttcaatgtgggcttttaaatgtttgcttttatttttacaatgtgggcttaaaaatattaaaatatttaattttatcaaatatacttaaaatgtagtaagtcttttttttccttttcattatgttaatatgaagaaatacatctacaggttttctaatactaagctactgtgcacttcctgataaatttaacttggtcatttattagatttttaaaaacacttctaaaaaatcttctctgtttattttcacatataccaggtgagttttggcagcctcttgttttttcttttttaccctttcttttttgttaaaaacatccttttatttatttaatgattaatacatggctattttgtgttttgtatctgataactatatataaagttctggggagtctaaaccaactgcttctaggctgactgcctgtcagttgcggagccttgttttcttgtatggttgtgagtttctcttttattgagcatcctgaggacttaaattaaagatgctctttcagaggtgtttgccaggagtcagagcacaggactgacctgggagcagtttaggatatgatccaggcttaatatgggagactctggttgagaccttaccttgcagagagtctgaaactggtttgttgaatgcagcgccaggattcatgctttcccacaagactactctggcgttcaactcacagctcttgtttcagcttctttttgaactccctctgcccctcaacacacaccttggaaatttccttgatatttttgtgaggacaacaatgcatttaaaagtgagagtggttgctgaataataaggaatgatcgttaactgttggacattgattctgatgacattttctcaaaaggataaccaggaatattttgtacaaaattaggattattataataggcatttagtttttcattgttacaaattttgaggaaaatcattaatcatttgaaaaaactaattgacatgtctccattgtagcaacttgtattttcacttctagtatcatgattatatcccctgtgtaatttggaaattgattttagcattaggaaatttcctagtttcagttaaaatgaattttttgtaagctgaattctattttacatgcacaactttagtttgttatttctttccttgacaagcatttattgaatgttgttatatgactaaaactgtaagatgataatgttttaatattttcacatttctttcatagcttccaaagtgtatatatatactcacatacttcatatatatgaatctacttatatactgtatataaaaatatgtatataaatatatacacattgtatataaatgtgtatatatatttacacatgtatataaatatacatacaaatgtatataaatatacatatttatacacagatgtatataaatatacatatttatacacagatgtatataaatatacatatttatacacagatgtatataaatatacatatttatacacagatgtatataaatatacaaatataaatatatacatttatatataaatatacatatttatacacagatgtatataaatatacaaatataaatatatacatttatatataaatatacatatttatacacagatgtatataaatatacaaatataaatatatacatttatatataaatatatatattttttgatacgtacaactatcttgggagatgggatattgttattatttccacatttacagatgaggtcctgtggttcatcaatctttgtgttttattcaagattatgtaagcagtaagggatgaaatcaggctgagaacccaaatttcttcatccctaaacaaagtatttcttctaaacatggtatccatttactagtttatctctatcaggtgaccctttattcattatttttcatgagaaggttgtagttgtacaaagtggctgatatctgataatgttttaatctaattcaaagtcgatttcttaaatccaggtgtcagagtagcacactactgtacaattctctgtttcatgttttacaatttaccacagtcaagttacaacttgcacatgttacattaaaatgtgaattcaccttaatttcttgaaatgagccagaagaagaagtggttttgttttgtgatcagggaaatgctacttgactgccaaattgtctagaacagcacattaaagttgcttgattttatactgttaaaattaaataaaacatggcaactgtcatgtcatatgtaacttttgtattattctgtaactttttttgaaaataaaaagtgatcaaattgatcttcaggtaaagaatcttttttctcttgattatctcttagtggatgatgatttgttccatttaatgggtagagaatttattgttgctgttattgtttcaaaagtagctgaatgaaactcttaactttttcttcatagttaaaattaaaacctcaagtaaataaatatttaacgttttgccaaactatgtaatctaattatgggcttaatgcatttaaaggctttgtataatttgctacgtattttcacacaagttacctgaacataagtccagtcttcctgctgttttctgagtcacacagtgattcagtgaccgaacagctgttggcagtggtgtgggtataatagggaaaagagactgatggggacaacccaagtttagacaagctggtaaaagtagaagaaaatcttcttgaaaacactagtgatcactaagggctgtggagaatttttgcttggtgggtgaatgtggaagaggcaacagcatgggaaggtgttggtaaaggagctccatacttgcttaaactgccttttgattgtgaggccgttgatgaatatttagtttgggctttaggttttttatgatacaggatattttccatttctggctttgtatctcagagatcacttagttacacttatagatgaataggagtttcaattccttgttttagaaagaagcttggtaactgttagtgagttacaaataagccaaatagaagaaggtacatatttctgcagtatcaggtaaagtttttcctcataaggatttagactcttggatatcatattaattctcagaagagtgggtataaaaaggtatgggacttcttcctggggtgggttggaggtggtgaaatacctttttttttttttttctgagatcatcatagacaagatcaaataatggtaaacatgccaatgaattttctaagcactattcctttaagtgaaagaagagtgtttcagtaaaatgatttaatattgggtcttccaaaagatggatttaagagtttcaactttaaaagacagaaaaattaagttattttacacaatgaatattgtcgtgccgtgtgtcacagacatgacatgagagggaatcagagaacatacagttaatacaacgcaaactagtatcattacttttgctcaatcacttccattgtctaagtaagataattaaaggacagcataaaataaaatttcaaaactttactcaatcatattaagctattttaattaaagtaaatgttttaatgccattgaatattcatcaccattcaaaattattgatgtaaatagtgttatatgttaaaggtaatttaacttccatggatgagaattcagctaatgtttcacttaacttttaggtaattttttcaatatcctggtattaaacgaagtccatgagtttgtggtgaaagctgtgcagcagtacccagagaatgcagcattgcagatctcagcgctcagctgtttggccctcctcagtaagtaacttcactaaaaaggggattcttacagaggcatttgacatcaaatatgaacattgtaacaagagaatcatatgtacagatggaagcattcaatgccttttctgtcctgtgtagctcattttccagtagaggatactttcaaggaaactaacagttgtgacaaatatacacatctcaatgtagagttttgctttacatcattcttgatttagctttgtcattaagcagctaatctgttttaaaaaaatttttatttgtgcctgggcatggtggctcacgcctgtaatctcagaactttgggaggccgaggcgggtggatcacaaggtcaggagttcgagaccagcctggccaacatggtgaaaccccatctctactaaaaatataaaaattagtctggcatggtggcgggcacctataatcccagctgctcgggaggccgaggcaggagtatcgcttggaactggagggtaggagttgaagtgagctgagattgtgccactgcactccagcctgggcaacaagaatgaaactccatctcaaaaaaaataatttatttgtgttttaagttctggtgtacacgtgcaggatgtgcaggtttttcacataggtagacgtgtgccatggtggtttgctatacctattaacccatcacctaggtattaagcccagcatgcattagctatttttcctaatgctctcccttctccagtcccatcccctaacaggccccagtgtgtattgtccctctccctgtgttcatgtgttctcattgttcagctcccatttataagtgagaacacgcagtgtgtggttttctcttcatgtgttagttatctgaggataatggtttccagctccatccgtgtccctgcaaaggacatgagataattcctttttatggctgcatagtattccatggtatatatgtaccacattttctttatctagtctatcattgatgggcatttgggttgattccatgtctttgctcttgtgaatagtgctgtgatgaactaatcttttcaaataatcctcctctcgtctattaggttttttttttttttggtaccttcttcctcattttattatttatctggataggatggtagcattatgagacgtataatatattaaaaattatctttataattgaccaaggcttctcctaaagcacacctcattctgttggtaatatttcaaaatatggacttagagttggtcaaactgttaagtagataatatatataatgtttttatatatttttcaatttttttcaagctgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggtaggactctcataaatattagagttattcaaaattatgttttccagtcatttatattttgacagatttcttttttctcccctaatccaggaggccgcatgctgggcactaaataatctccttatgtaccaaaacagtttacatgagaagattggagatgaagatggccagttagtagttttgattttatatgatagaaaatttcagttatattttaaatcaatacctataaaataccttaaccgtaacttttattgttagaaatatttttgatataggcatttagttttagatgttgctgcaaaatagtagtaggtatgtagtattttgatctcatcaccttcaggagttagaaaaggtagaatgagagttattattgagagatttggaatcaagggtcatttggtaattcatgaatcatggagaaagaatctttctattttctggctgatcgttttaaaatgccatattaattcatcttgggtgatagaaattgcagagccatctgtgatcttttcttctatggtgactagccagcaggttgtcaatatcagaaattagatttggttagagagcttcctatgatgagttcccaactgatgtgacagagttgacctgtcttctttcgagagggttatttgaagctgtcatctctggataactctttcaataggagtgccattcaaacatcataagaccggcactctctcccaaagatacaagctgtagcaaggagttttgtgcatatcaggtttgtttcatatccgtgagcctttgtgttttatggcaactgattgattatacttgtgctatttgcaatgggtatcctctgggttttaaatagtgaatgacttattttggaaacaaatagtagtattctatgtctgaaatcttgaccgtctatttgtttaattatctattgctgataagaagggaattaataacacagatgctacttaattaaatattttcattttgacaagaaacagtaattcttttgaaaactatgctaaattggcatcttaataatctcatgttgagcaaggcttttggagattagggtaagggagattcatgtcgcagtttataaatttcagttcataggatacctatttttcaatatccataagataactttaaaataaatatattattaaaacaaagaaaatatatttacgttatacatctttaaaacctaccttgcttctttacaattttcagtttttcctctcttgtttccattctcttctcctcactttacctttttcctcagcatctctttacatatctgctgagcttttttatttctctctgctgcatatgcttttgaaaaagcataaaaatactaatttgttaggatttaattaattcgagtcttaaaaaatgaactataattcactcttgtaagtggaggtggcatgaaatattgtttatatgctcttaattgttgttagagatatttgataatggcaagtgagaatttgagatagttatttaaaagattactactaacattttgtttgaatttttgaaagtttcccagctcatagggaagtgatgctctccatgctgatgcattcttcatcaaaggaagttttccaggcatctgcgaatgcattgtcaactctcttagaacaaaatggtaagcagtgggccatgttttcaaataaagggaaacacatttttgtggtatttttaattatagaagctatatactgtgaaaaatttacataatttataaagctatatattgtgaaagatatctctatgtgtagagatgtattgacatatggattatgaatatataggtaaaaggatgaagaataaaataaacatttgttgtatatttttccggacttctatgtgtaaactcacacatgacatatacaaaattttatgtattttgtagaaatgggatcatattatactcttttataaccaaattttatttattctcttttttatgttgatacatgtgtattctcacattatcattttatttttaattttttaaattaatttttgtttttagatatggtctcactctgtcacctaggctggagtgcagtaccatgatcatggctcactacaacctcaaacttttggactcaggtgatgctcccacctcagcttcctgagtatctgggactacaggcatgcactgccatacctggctaattttttgcagagatggtgttttgccatattgcccaggctggtctcgaattcctgggctcaagcaatccatctgccttggcctcccaagtgctgggattacaggcatgaaccactgtgcccggcccaaattataatttttaatagctttgtagtttttcagtgcttgcctgtattctgttttatgaaccaatttcttactgatgaagttttagtttgtgtccagtgggatgtttctggaacccatagtaaacaccagtgatcactttcctcctctgttttcctttatacatggttcctattattttcttgggaaaatttcatagaaatgcaactgggtagagagctattcaccattttaaaatctggtaaaattgtctattataaatttccacactatacttttttaaaaaatcgttctttaatgtaattcttataaatcttatagctttgtataattatgaagagaaaaatggcttgtatccctttagaaagacatgagttttaagattatggttcaggctgctcaaatttcttcccccataaacaggaatactgccagaaatccttaggtgaaaactcatcataaaggcattgggacttggcagcttttgcaggacatttttagagggcaaaaaatagagaaaaacactgaaagtcagagacagagaccagtgtaagcatcagcttttaatagagaaactgggtagggtggaaaaaaaataaagcaaccacctcatgcatgtttctttatattattattgaagtcaaataaagaggaaaatcatttcttcttcctcttcctcctttttcatctcacctctccaatggcactttaataaaacgcttggagtggccagggcactgacagacagacaggggctgctctcaaggataatgagtcaaaggggaaggagagggaatcgctgttctcgaatctctcttattctactgtgcagttaaagaggtctggacagggatttcactcctgaaaatgaggactggactttgtggcttctgttggggcacctttagagtggaggtagacttttactatgtacagacaacattgtgttggtgacatcattcataaccacctggaaatctcctttgatatgcaaatcaaacaaccataactttgtgaaatttcgactgcttcctattgtggtgtctgaggactggttacattcagagtccaccctgatgtctttgttcagttttctgctctttctagttccttacttctttgttcctgatcacctgtcaagtaaaatgtcctcagatccttttgtattgtctttggagttctgccttaataaagcatgaagaacttgagtagctcgttcatcaactttcttgggcaatttctcattgaaagacacttgggtgtctttgggtgtgcagagctgagcatggctttatgtttttagaaaaaatggctacattggcaggcagaagaactgcgtccttggaatcatggaggtcccaaggttgcatacattttgtgtgacatttttcctattcaattaattaactaatatttattgagctcccaagtgtgtagtgtctgtaggcacttgggatgcattcattaagtaaaaatcccaggctcatggagtttaaactgtagtagggaagataataagattaactaaaatatgtaatatttgaggcagttaagaataaaaaatgaagcaaggaaggagaatatgatatgttagacatcagaggagatgaagttgtgaataggcagccaggaaagaaggtgactattgagtaagacctgcagggcgtcgcatattgttttttgcctctgaaagcagttaatttcctgttaaaatggagtggatgagatcaagagtattacgtagatagctggtaaatgcgatagtgtgtaaaatgttctataaagtctaacgtgactttatgatgaaatttcttcttctaggtttattgcttgcaattttcaaaccacacattgggttactgtctaggatagtgattcttaaagtgtggttcctggaccagcagcatttgctgggggaacttgataaacagtgtaaattcaaggaccccatacagaccttctcaatcacaaaccctggagttgagacccagcaatccatgttttaacaagctctccaggtgattctgatgcacactaaagtttgagaaccactaacccagtgtcatttttgtcttttaaagtgtcttcttggctagaagctagccactttgggaaaggttattacaacttctgatgtgatcaagcaaagtaaccaactctttattgtatcttaatatgtgatattctgaatgtgtttaaaaggtatgagtttttcaggctctggcagtattttagaatgtgtatgtgatttctatttatttccatgttttgtcctatcttcttaagatagactacttattttaaaagcagtacttaagttaaaactttttatgtttctttttctgccactttcaaagtgttgaatcacagtgtgtaatgttggaactgatatttttatagcggcttcaagacaattgatatttatgtggaaacttgaagacagtaggtttatgtttagtgaaggaagtttattacaaagaggaaaattggccagttgtggtggctcacgcctgtaatcccagcactttgggaggccaaggcaggaggattgcttgagctcaggagttcaagaccaggctgggcaacatagtgagatcccctctctacaaaatattaacaaaaattagccaggcatggtggcacacttgtagtccctggtacttggaggctgagacaggaggatcacttgaggccaggaggttaagactgcagtgagctatgatcatgctactgcactccagccttggcaacagagagagatgctgtcacaaaaagaaacaccaacaaaaaaagaggaaaattattccttaatcattattgctggaatatagttactttccacaaatagtgaagtgccagttgtaaagcatatctatatgtttcctagactttggcattactttgtgaaaataactgtaattacttatgttctatgtaaatgctttccattcatttgtatatgatggcatatatagaaattataatgtttgtaaagtccactgggataaatggacaaagcagctgaaggctgaaagcaaccaagccttttacagccccttcattccccacactcccaaaaagctgagtgaatggtcgatacctccacatgcttataactcattcccagcccaccagtgtctagcatatctggttagtcttagctttatataagtgcagttatttgtgaacttgttttaagtattggaatacaatttaactttcattcttattttggagaccattatttaaacagatttcttttttcctgcaaaaacactcttttcacaatggacagagacacggtgattacattaaaaccatctactctatgaataaaaatgttaaaaccaaaatcccaacaaagggttaataaaggcaaaaaaaattggaaatgacatgtgttttaaagaaataaacatgaattatctttaagctgtcaatgaactataaattatgtgtgctcttgtatatgctttcctgtaaatttggactatattaatattctaaagcttatggtaaaattatgaaaatatgctttcatatctataagtaacattttaaaaaatctcagttaatttcagaaaaatactgttatcaaaaggaatacacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacataagacacttgaaaactgaagcattttgcaatgtaatctcgtgtcactagtaccatagacttactttatctgaacactgaaaggaatggcaagattgtggaaacatgttgaaggtttgcttttgaacctgatgcttgatgttgactatattttgaaaagtggtaattgtatagcacatagcatacagcagtttttctaattattgtgtgtgtgaaagttataaaagataaaatcagtttatggctaaattttgctctttcacaacgaatatattattccttcatctgaatgaactttgtcttctcttcctgctctcaatccttagttagggaaaattttaactacatctagtccaagtgcagagatgctaagattatatagctggcggttagtggcacaacagagaccatatcctttgatctatgtgtggatggtggtggggcagggtgggatgaggtgggggtgaggggtggtaggtgtgggcagaactctcatgtgtaaaaaaaataattggcacagaagttgcagtgaaaactaattttgttcctggttttgccactaatttgagccaactgtttcatctctaaaacttcacgttcctcattgataaagaggaatgataataacaactttgaaagttgtaagcttagaatgtaaggattaaataaattaatttttacaaagggattaggataatgcctgctgcattttaagcactcaacaaattgtgtctattgttgttatactgttactaagtgtgaataaatgaagtgcatatagcatgaaatgtagcgtaactgcagacttgtaagaagtagggttacactgtttttaacatcagtctaactaatctatgtttatatatctttctaagctgtatttctcttatttaagtgttgtttttgaacactgagatgaaaagtttatcttaaatgttgattttaatggggccggaagtgtgcaaacctttacaaatgaggcaaaaacacagcggaataaactccagtctaggattctgtagattctgggcaaggcatttaatgtttctcgctgcatgctcttacgtaaaatgtgtacagttgcagccctggagattccgcattggctctgacagtgtgtctgcccctacagaactcatgtgagtcgagagactgataagtaaacagattattataatacagtctcagaatgcagtggcagtagtgtgtaaaagacgcaatggtaagagtagagtggactcagctggggttacccaaggaggggaggctccaatggagggatgtgtttaaactgggactttaagttggaaaagaaggaatgtatctcagtgtccacagaaccatgcaaagtgagaacatggttctgatatgcacaagtttcagttaacaagcaaagcaaggattgactgtattaaagttcatagtacctactgcattctagtcaagtgacatttgctcatatgtaaaagaaagaatagcttaaatacctgagagaaaccaagactgtaaaacaaattaaaaataattaaaaataccttataagaagtccagtgatgttaatctggaagaggaaggttcgtgtgatgtaaagaggccttgtcttggggtcagacaagtttgggtaccagccttgtctctgtcactttctagtgataagacctgaatatttaacctctatctgtctaagttcttcatgtagaaaatggggataataacacctacctgctgggattgttgttattgacccatcgtaggtcagaaggatgttgttagttttatgaagtgaaataattcccggattactatgaattctatcttatgagttcaaagtttagacaattaaaattatgtatgctcatactactgatttcaaatgcattttcatatagtctttcctgataaaatatattggttctgccctcctgtacttatttcaatttggtgtttataccattgaatcagatcagtctttcaataagcatgccaattttatatccccagcaacacttccctggatataatggcagcagtggtccccaaaatactaacagttatgaaacgtcatgagacatcattaccagtgcagctggaggcgcttcgagctattttacattttatagtgcctggtaagttacatagttgattgtgggaagagataacaatttaaatggatttttgatttttcatgaaatagcaatattctaggcaaatattaaaagactagtttctgtcgactaaatgtaaatctttctgttaaaccaaaaagaggttaaatatgatgcagaagagtcacttagattaatttttataagaaagcaatatgaattcagtaatttatttatacaaagtaactacaatgtaaaatgtggagcttttatttttaaggagggtgttcatctctgataattcttttctatttttgttgccatgacctgagttcaagctttttttctcttgtttgaattgtactattagctaattttcatacctgttctcttccttcatttctatccttttcttactctatgattgaattaatctttctccaatgtggcttgtactcatttacctcaatggcttccaccctccacccacctttaattgttactgacatctgttatcaccttatttgttctccaaagcccctttaaaacacctatgtctgtattcatccaacacatttattaagtgcttcttatgttctaagcactgtgatgctgttaaactttaaaagatgaattggaaaaaaagcacaactgtactattataggagcttagaggtagatggaagtgtaaatagataattaacaggcagcgtgagagaggcgatgatagatgcatatataaaaggctttgagaatatcgatggaggcacaaataatttcttcaaaggagtaggacagagattgtaatatttgaggtggaagggtagatagagctggcctggtagaaaggccaaggaagacatttcaagcagaagaaagtgcacatggtcgggggtgagtgaggcatggaggataaggagaggagtgcttggggatgagtgtggaaggaaaggctgaggcccaaagaaaagggccttgaatgcagtgctaaaaattttttgccttttaaaaatggaagccaacccaagtttattaaaattgtttgcagattgtagtgtcacaccgaaatttgcaactaaagacaatagcattgtggtgcagaggatgatagacagggagagagactagatacaaggagattgggttggaggtccatggtagtcaagtgagacccagtgaagggacccagcaatggaaacacagatgagagggcagattggacagatggttgggagatctgtttgatgtgacatcgtgatccctaagtatgagggatgatactttgttctgtgaagttcccaatcttttgaagtcatttttgctttgttcttttaaaatgaaatcttcctaaatctatcattttctctagttatataggtattttgtttctctgtataagagtattactcaatataaaagttttttcaaggacagagctttcttcagtcatttttttctgggccccccagtcctctggtggctattcaatcagtattttaaaaattgaatcatggtgtcctattcatagtttcagcttagttttgagacgtaatgtaacagatgtaattttacttgaaaatattattgcatgttttattgaattttatttttagattgtaattaaaaacaataaaaatgccttttgattatccttaaagttgacagccttattcttttgagggaggttttgggttttaaagataaccaaaggacactcaaaaaccgtttctgttagttaataaaataatactcttttagtccaaaagcaagttttgaatacagtatttcttttcttttattgttcttaaactgatcctgaaggaaaattgttagttaacaatcaatcagatgtattatgggtgcccttgaaaataatcacttgaggactgtacttaatgtaaaaaaatacattttataagcatatcagtatgtaagtacattcttctagtaggtaaaggcttaatcatttactgtatgctaacatattatactaccacagtacaccatactgtactgtacccaacgtaatgtaccatgccgtgcagtaccgtatcattctaggtatcaacaagtaactatggtagcaatactccagtagttttgaggttgaatatgattctggtttgaacatgttaagttgaggttcttatgagatacctaggtgtacatgtattcatttattagctagattatattcaggttttttagtggcaaagatgtacattatggcaaatgtgtataatttagggtccaattaaggatagcatattgcatctagtgcatatatcttaagtttctttcaatctattactgtactttttctcttctactttataataacttgttatatagacattgagctggttgctttaagaaaataataatgaagacccagttactttaataaaatatcatttgacttgtttcttgagttactgctagttttagaggaaataatgtgaaattctttaagaagggatataggcaaattgggaagtatatagaggagagtgattagggagataaaagcacatcaaaaagagcaataagaggaactgagattgttttatttgaagaagagatgactcaaagggatatgaaactctattcaaatctacttacttataaccagtaacagtaataataccaaacaatatggaggacttaaaaagtattaggcattgtttgaagtattttaagtatattatctcttctgattctaacagcactccatgaggcagatattattattattattattttggtattgtatggactacaaaactgaggcatagaattgtagagatttttaaggtcaggcctgatataacagcaccagattttcagcttatgcaggctgactccagagtaggcattttaaaataaatatttgtgcaacaatcttgtcctgaacaactgttgtatttaaagcactatgtctagaatccttaaggtatcgggagatgatgagattatggatactgctctcaaaaaaatttacagtccacacgacctaaaggactgttatgtagaaaggaaattatatccatttgaatagtaggacctcaagtgatagaacaaagactggagaagaaatttacaggaatgttcatttggtcttaatttaaggaagatgttaaataagacccattacatgtagcatgatgtttttactactcaggccagttttagtggtcacatcttcttaaggtgtaataggcagcctcagaagttactgtggtcttgctcactggaaatgatacacagacagtttaagggacttgccccagaccacacggcaagaggtgaatgtcagaacctctttgagtacattttaaaataaggactgaaagttggaggagggtggttatcaaggctgccttccttaccatagtattcccagcattaacaaaatccttggcatgtaattggaattcagatgcttcttaaataaatgaaaagcctgttgtagccagcttacagtttgcattaatgcagattattaaagtggaagatcataaatgattttttattaatatttatgtctataatcttaggtttggaaaacattattcattcataataattttaattatatgttacattaccacatttttgacttgtagtgtttttagcatagttcagctacagtgtagcttaataaagaatatgattttttaaaatagcaatgctattatatagcctttacagaacttctaaaaaatgacatgttctctaccaccttaatactgaaactcaaatcttattttttgctacgattattccagctactcttttttgtctatatttcatttctgcctttttatgttgtggtccaagtaactctgagcttttctcatgttgtccattgttgcataaaaatcttccagcatcttaaagcacagcctactcacacaaaaaagtgattgtttgctacagaaaatttcttcaccatcgtaattttttgctacttcaaattcagtaagcattcttacacattatatttattttatattcagtgatgaactatttttatagattccttaaaatttctggttatttatttgataaggaaacatgtactagaaaaaagtacaacacatatattgtgagattaattatgacaatttctagaaagtaacagtctgttcaactcaaatgtttataagaaaattctttctttatttatttatctgtgcatttaggcatgccagaagaatccagggaggatacagaatttcatcataagctaaatatggttaaaaaacagtgtttcaagaatgatattcacaaactggtcctagcagctttgaacagggtatgttgaatataagttttctgtatttatactattaactaaaatattaaatttggagaactaggggcgctttttcagtctaagttttctgttctccgtttgctatgataggaggaagtcatgtggttagagacataagatgacagtggggatgtgggaagtgaaaagatatgtactaagctaagtccagctaagtgtattatcaattatagatgtaggcaagattcttttgattgccagtaacataaatccactctagtttgctcaaccagaaagagaaccaaagagccatatatgcagctagaccttgtgagtcatgctgggtactatggctgctgttttctctttctgtcctctggctacttgtctttcttttctggtctcatagtatatggtttagcccatgaagacataccagtgttaacagtaaagtcttcggctgggcacagtggcccacacctgtaatcccagcactttgggaggctgaggtgggtggatcacgaggtcaggagttcgagagcaacctggccaacatggtgaaaccctgtctctactaaaaatacaaaaattaactgggcatggtggcacgtgcctgtaatcccagctactcaggaggctgaggcaggagaatcgcttgaacccaggaggcagaggttgcagtgagctgagatcacaccactgcactccagcttgggcgacaagagtgagacttcgtctcaaaacaaaaacaaaaacagacaaacaaaaacagtaaagtcttctttgattccctacgctccttttcattgttctccggagaaataacctctgaaatgatttggtatacattgtttccattttttagcatttacatatccatgttcctacattataattaaagtatccataaatcatactgagtatgaaaaagagaagaagggaattacatttaaattgtgtaatgcaaaaagtattggtggaattaagaagttttggaaattttgcataagatgaattggttctttattaaagatgttaagaataaagacataattagtgtgaacatttttataaaaggaggagcctatttaaaataattaatggaaatgattccatgtgatttgatatactttgatgaatgtcataaattaattaaagtggcttccagagagatctcccttaaaaattcattttaaattgaactttatactgtcactcactgcctataatatgtttgagtcatttatactcaaactttaatacaatccttgagtatggcaagaatttatgttgtaatgggttaaatttatcttgagaaatatttgttgaaaataagtatatggaaggaaggggttaggcatttagaagataaataaatatgctttgtactcttctctcctgaatctcataagccggttgttgatggctgttgtgaaaccttggttcttttctttaaacaagagacacacagcagaggagatgcagcatcgagtaatttattgcaaaagaaaaagaatattttgcaagttaagtgaggaatagacacttataccctgacagaattcagggtgggcttactagtaaggatgagacagcgtaaattggcactaggaagactccctttgtgggagttgtacatgatttttcataagtgggtgggaagaagtgttactagtaagcatattctaggttgtcctctgagtgaacatgtgcagtagctgtacatgcttgttcatatatcgcatgtctcataagtatctgaaatctccacccaggggtgtgtgttttactattataatgagcaaagggtcagtctgaggacaaggaaaatcaaaatgtgcatgctccccacgctacctgacttcaaactatactacaaagctacagtaaccaaaacagcatggtactggtaccaaaaaagagatataggccaatggaacagaacagagccctcagaaataatgccgcatatctacaaccatctgatctttgacaaacctgacaaaaacaagaaatggggaaacgattccctatttaataaatggtgctgggaaaactggctagccatatgtagaaagctgaaactggatcccttccttacaccttatacaaaaataaattcaagatggtttaaagacttaaatgttagacctaaaaccataaaaaccctagaagaaaacctaagcaatactattcaggacataggcataggcaaggccttcatgtctaaaacaccaaaagcagtggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatctagaatctacaatgaactccaacaaatttacaagaaagaaaaaacaaccccatcaaaaagtgggcaaaggatatgagcagacacttctcaaaagaagacatttatgcagccaacaggcacatgaaaaaatcctcatcatcattggccatcagagaaatgcaaatcaaaaccacaatgatataccatctcacaccagttagaatggcgatcattaaaaagtcaggaaacaacagatgctggagaggatgtggagaaataggaacacttttacactgttggtgggactgtaaactagttcaaccattgtggaagacagtgtggcgattcctcagggatctagaactagaaataccatttgacccagccatcctgttagtgggtatatacccaaaggattataaatcatgctgctataaagacacttgcacacctatgtttattgtggcactattcacaatagcaaagacttggaaccaacccaaatgtccaacaatgatagactggattaagaaaatgtggcacatatacaccatggaatactaagcagccataaaaaatgatgagttcatgtcctttgtagggacatggatggtactcagcaaagtatgccaaggacaaaaaaccaaacaccatatgttctcactcataagtgggaattgaacaatgagaacacatggacacaggaaggggaacatcacactctggggcctgttgtggggtggggggaggggggatagcatttggagatatacctaatgttaaatgacaagttactgggtgtagcacaccaacatggcacatgtatacatatgtaactaacctgcacgttgtgcacatctaccctaaaacttaaagtataattaaaaaaaaatgtgcatgctccatacaggggcaattccctactggagatagctttgcttaaatgagctggactacaatgcaaatgctgaaacttactatattgacagtaagattgccacagttgccgcgtcctgaggacatggttacttccttttaatacctatcctgtctcattgtgagaggattaacaactgtgcataaaaccagttgttctacatgagcacttaggagggataccagcattgtgaacatagtttaagtacgtagaggagggaacagttaagtttattcatggtgagtgttggtgaaaagtggaagaggtaccaaaacagccgtatagataactggttccagttagccaacattctctaaagttattagagaagcctaagtgaggtgtaacctcagcagtcgggagccaagagagcaagtaagtgctgtgatgtggagaaaatcactttgttccaactgagaagaaatggttgagcactgcttttcccccatgccagtactgacgcacagcctttcacttagcactgattatcgataggggtggggagttaaggtatggggaaacacaagtaacaatattttatttcaaaaacctctccactgtaattcccctaatccttcatcatggttgaggaaaatggctctaaaaaatgagagcaattactgtagctccaaaattctgtgattgcatgtcttactctgaatagcaattacaaagcatcagaggatttaggtccaaatattgcagacacaagaaaatgaattacattttaatacatctaaacttggagagcagagttccaaataaggtagaacttgagattcaactctgatttataaagcagagactaagaagagtatttataaagcgaatccatgtttggatacataaaagtgcaataaaattcaagctgaagttaaaatctctgtctagaacagcgatgttccatttatgcctgatccttttagcttttccacagatgaagactttgtcacctgttccagagagatatatttgttcattattgtttccagagagcaaaatggaaaataaactctgcacattttggccgcatctgtgttttatatgcggtgacactcctgttctcttcagtgaggaaatccagtaaagtaaaaccagtcttctgatgaaatgggcacaaatcaaagaacttgtgagcttcacaaaaaccttgaagcaaaatataccaagcttaaatattgaatgtattgatttcagtagtcaaaaacagagctcatctgcaaaagcaacaacaacaatgacaacaacaaattacatataagtaaaatttaaaaaaggtttacaggatgaatatacagaaaactatgaagcttaggggtagagaggagtagttgaatatatgaaaagatacatcttttttgatgaaggactaaatttttaaaaatgaaaattgatctatgtttatgaaccattagtaaaaataacaatagtattttctggaactaagtaagctagtgtaaaatttgtatgaaaaaattaatacatatgagtaatcaggagaattttaaaaaagagtgttgattcatatggcctaactccaaaagataatcaaatgtattatacaattttagtaattataatggtgtgatactggcactaggggagagagatcagtgccacagaagggtggctcaggaaatagactcaaataaaaatttgtaatgttatgatattcctcgactgcgggaggaaaatagattactcagttacttgtgttggaacaactaactcttcagccatttgggaaaagcaaagaaagctgaatatttatcttactccttttgccaaaacaaattacagatggatgagatttaaagtctataatgaaattggtatatgtacatattaaaagtttcaactataattgttattaacgtaaatgacaacggaacaccttgttggagggaaatttggtaatatctatcaaaattaaaatgccatgttttctgatcagcaatttcattctaagaatttttaatgtagatatacttgctcatgtacataaagattattagacatgaatgttcactgtggcatgattcgtaattaaaaatgtggcaacaaactaaatgcttacatggtaatcattcatgctgtttgccagatatttttatttctccaccttgtggtgattctggcatagtatttagtagttaggttgaagcatgtgactaattttggtcagggagttgtaaatggagggaatagctggtgagacatcttgcggaatactgtctcaggtaccatcgtacctgcagtgtttgagatagtagttgctccatcagtagaggtccctgagggactacaacaagcagagtcccctcctgacctgcaacacatatgtagcatgagcaataatggaacttattatttttgcaccctataaaattttgagaattgttactgcagcttaatttaatctttcctgacaatacaatacctatcaatagagactaatcagataaattataccatttccaaattgtatcatcctgcataaatattaaaaaacaatgaggtgagattcctaatgtgctgctatggaaaaatcttcaattttctatgtgtacgaatgtatttcccaggtattcgttttttccttcctgtatgttgacacattatgcacacttttggatgaaattaatatatttccaccgctttatgtcctctccctcacttttatcacccaattgtagcaaagtatatgtttgcttttatagctttagctatataaaattttctaatagctaagtttgtggttcctggaattaagatatctgaatttaaatctaacactactacctacagactatgcaccctggacaagtacttaatgtcttggttttgttatgtataaaatggagataataactgatttttcacttagagttgttgaatattttataagataattcatgaaaaagtgtcagtataatgcttggcacatagtatgcgctcaataaatgttaatgttattactattagatttaaaagtatcttttgacccctggctatagaagatgaggaaatcagagtatttgcacttctaatatctcctgttttcccacctacttttgttcaataaattaactccacattggcagggtagataatatttatattcagctttctaattatgctttctaagtttgtgtttatcttactcctaccgttatttggaagcagtcttcatctcaagtccttttgttactgttttttcactcatcttttagttgtctgaatttctttagaaaagtttaattccctgaatatttaatgtttatattttgttgttgtttttgcctttatatttggactcctaaaaaaagttttgttggttgtaaaatattgtttttttttccttgaagtgtttgtaggcatttcactgtgttctagtactgaatgttttagtggagaagtctgaggccagcttcatttgtttcttggatatttttgcccagtgctgaaaggattttttctcttgaaatccatccactttattagggtatatctcaatgttagtcctgggatatggtatcctcattctagctatacattcaacttttttcctggaaagttttcttgagttgcatctttatatacatatacatacacgaatacatatacatggtaaagatattaaggataaagataggtgctttataaataccaatttgatataattttggcatgaaaaaaagcctgtggtgcattctgagtttggaagtagaactggatatacttacttattactattgtttttaatacaaaaatggagacagggtctcactatgttgcccaggctggtctcaaactccttgactcaagcaatcctgcctcgacctcccaaagtgctgagattacaaatgtgagccaccgtgaccagcctaaatatctaaatttttctctttcattattttagctctcttctttggggctatcagtcatatgatgttggatctcttttgccttaatcttctaatttttcaaagactaatccagagaccactatctatcaccatgccattactcatagacaagggacatcattccacacatttagcttatttgtcaaaatcagagatgggatttataaaagaaaaagaataaagggagaaaacaaaacacaaattatctgggaatgcgagtctgttttcctttctttggctaatctacttacctagtagctaggaaagaggccagcatgagtatttttccattgagctggctagctcagtcattggagaaaccatttcaatatttatggattctctgaaaaaaacttggagagtaaaaaagcataggtggtaggatgctgccatccttctgttggcatctccagagtttcacttgaaaaacacctcctaagtagacactgataaattgattttaatccctatttgagcaccaatgcaatacattactatttcaagatggagcattagataactaaaggaaattctattgtgggcttgtaaatatcatgatagtcatacctatgtaatacatatatgtatatataaatattaatttttaaacatttacttagctattaaaaatcaaatgctcatatttaaaattattggtttattaatgcaccatcacatgttatcatgtgatactctgaattctctttttgcatagacaaatcagagattacctgctgcaagtcattagtcatcattaacctgtactgaaatggttagagcctaggggagttccaggtaaaaggaccagtaatgagtagaagcttgttagatgtagagatattgaggacagagataggtgctttataaatatcaatttgatataattttagcataaaaataagcctatgatgctctttgagcttgggagtagaagtggatatgtaattttcagggcgtagtataaaatggaaatgcacactccttgtttgaaaattattaacgattttacaagggtgacaacagagcattgaagcaagtgctctgtgagcatgaagccctgtgtgaaatacacacctgtgaagctggccttgcctgccaaacaggaatgctggtactgttaatcaaacagaaagttcagaatgacaatctgacttttttttgtagaagatactaaacttttggccttgaatatctgaatttaagatactggtatcaagccaaaagaaatttgggcttagaacttgaaagatttaaacttgtgctttgacttgtgtgctcacagctctctgtgtcacaatttttttcatctgtacttcgggacaacaatagtgtgtcgacatcacaaaggttttgggaggattaagtaggtgaatacatatgaagttcttaaaagaatgtctggcactgagtgagtgctacctcggttttggcatcgttattgtggtcattgctattgttattatgacttgaagtcatattagtgtatgaaatcccatccatgaatagaagacagaaagaactttgggcagggtttggaggtaaaagaagacattgtaaaggagatgggtaaaggaatgattttaaagactgagaataattaggggagtacgatgtcatggaaattaagggatgataagcaccaattaagttgttattggacttttttctttgaatggttcaaattcagaataataaggaaagaagtctgattatacgaaattaaagggtagggtgactgtggaggtagtgggagttgacttttctgctaataagtttagaaataaaggaaaaatggtagcttgaggaaagagaggagcgattaagggaaagtctctcgttaactcttgtttttcatctctgaggacagcgcttagcccaaggcctgacctgtgatcattactctctcaaggtttattccatggacagagctatctcatttcatgcttataacaaccctacattattagaattgttttagagatgaggaagctgagacacacaccaaaccagccttccaatttcactttgcacaactttgaatttctttatatttcttgaataaaagttccactttttaacttaccacttcttagcagtcattgtctaactgagtaattgttacttcattcatttaatggttctcagattcgcataatttgaacctaaatttaattggcctccaagctgatgtgcttacagaaacagtgacaggaaacaaaaatgtcaagggagactatgtattattaagatgataaatgaaatgatgtccaagctgagcaattaaagtgtgaagtagaaggacacagggtgagaaactgatgcttctcctcagcctctataaaaaagatactgaataaagataattgagaggcattaggggactagactgagaaaggattggaaatctgttcactgagagtacagaaatgaggaagcttggaaggcagaagattttggtcaaagacgtctggcttgaagctatttcagctctttggattatctgtggtggaggccatcacgtctttggagtggaggtaccatgaaactagtgtctgcaaaacatcatctaaatgaaagcaaaattcctgagaaggatggcactataatttttaaaagaaaagctatgagttaagcattcatatcaaggtagatgtttggagtgtattgcttgtgtgtgaaaaggcagagatgaccagaataagagttagaggtatgctgcgttttcttcttggttgatgagtaggatggcctggacaaagaagtgacctctagtaaaataccttcatagtgtcaaatcatctggaggaaattcagattaaagaggttggatgatgtcgtaattaagatcctgggcttttaaggtggacacatttatattcaagtcccaggcccaatgcatattagctctgttacttgagcttttatttctgcatctttaaagtttggcaaacctattacatgaagctgttgaggggataaatgaaataacgcatgcaaagcacttgcagtaaagactaattatcaatattttatttgttaagaggcagcattgcgttttactggtcaagtatgtagactctggggtgaaacatatttggtttggtttcatctctgcaatttatagtttgtgtagactttgagaatagttctcaatcattctaaccctcagtgaattcatcttctaatgggagtgatatcagtatggatttcatgagattatgaaaagaaaatgcctacaaagtatttattacaatgcctggcacagaacaagctctccttaattgtaaaaatgctaactcttattcttcataataaataaaagtaattaatgttatagaaaacaaaatcaaggatactgatttatatttggattacttgatttatattttgtcagtctataactggtcttaactaaggtaagtattaagatctcatttttaacagcgagtattcttttgattttagttcattggaaatcctgggattcagaaatgtggattaaaagtaatttcttctattgtacattttcctgatgcattagagatgttatccctggaaggtgctatggattcagtgcttcacacactgcagatgtatccagatgaccaaggtcagtacaatttgaattcaggatttagaatagatttttgtagggcattagctggtgactggatgtctttaaatatttttcttcagttttgagatttaaaacaattctttttttttattttcctagaaattcagtgtctgggtttaagtcttataggatacttgattacaaagaagaatgtgttcataggaactggacatctgctggcaaaaattctggtttccagcttataccgatttaaggatgttgctgaaatacagactaaagtatgtgcattatcttggaaagaatttgggaacttgtgcgaatttcacttttggagcagtttgtgtaattcccactttgcatgaatggggtattctagttaatggaaaaccatttatccttttgtagtattttaattatacaagcaaagaaaattggattgaatctctaaagatccagtgtttcattatgaaatctctaaagtcagcatggttattcaccatttatcttgcccataaaagttcagagaatgtgctaagaaatcccagctagctgagtttattcgcttagattttagataaatagaatttataaatattccaaagtttgtcactctctgggttttattgcaggttgcttacctttagtaattttgcttgttgatttttttccttgcagtgaaaaaatgtttttaacatttttcatcaagcaaaatttaaaacatgatatataataactgtctttgtaaggaattcaagatactggcctagagttagttcacgggagattaagaataaatttgttttgttttgttttttaattgtagcaaaacaaatagtttttcttcaagagtttctgccttggttgtggagtttgcaactttcataaactacaaaggaattttttttttttttttggagacagggtctcactctgtcacccaggctggagtgtagtggcagatttcagctcactacaacagctgcttcccgagctcaagtgattctcttgcctcagcctcctgagtagctcagactacaggcatgcactcccatgcctggctaatttttgtattttttgtagagatgaggtttcaccatatttcccaggctggtctcaaactccctggtctcaagcaatctgtcctgctcagcctcccaaagtgctgggattacaggtgtgagccaaggtgcccagctgactcaggaaatattttttgtaactggcagcattgaccaggaataaaaatacctggtctctaatctttgcacagacattatcagtaaatgagagaatatgtgtaaagttttttaaaaaattataaagttatgaacatacaaaattcttagattaataacaacaatgtgttttataactgcttttcataatgtgcctcaggctaggctgattaaaccaagataggattgattaaaagtaatcttagggaaagggaaggattttgtgccggtatggaactctcagttactctggattaattcatctaggcataaattttagaatctctatagtagagtttatgaactaaatctggcctgccaacatattttatttgtccagttcagggttttgctttgttttttgagacagagtctcactctgttgcccaggctgtagtgcagtggcgcagtctcagctcacatcaccctccgcctcctgggttcaagcaattctcctgcctcagcctccctagtagctaggactacaagtatgcaccaccatgctcagctaatgtttgtatttttagctgagatggggtttcgccgtgttggccaggctggtctcaaactcctgacctcaagtgattcactcacctcggactcccaaagtgttgggattacaggcatgagccactgcacccggccttcagttcagtgtttaaaagtttttaattcgaatgacgtactttctgcacatttgcatggcctgctctgctgtagcattcacttgttttcagagacctctgctctagaggcaggtggatcacctgtccctcagacatacataaattaaggctactttgcttatcaaatattagtattcgtagatactcagcatcataagagttcgaagtaataattttaatatttagatgacgtaagttaatttaaaatttttttgagatggggtctcactctatggcccaggctagagtgcagtggcacaatctcggttcactgcaacctctgcctcctgggcccatcctcctgggtgggctcaagtgatccacctcagcctcctgagtagctgggactacaggtgcatgcacgggtaattttaaaatattttttataggcacaagattttgccatattgtgcaggctggtcttgaattcctgggctcaagcaatcccacagtgctgagattacaggtgtgagccatggtgtctagccaattttattaatatgtaatattagaggtaataaaacattaaaaagttaagatgatccttggtggctttacccaacctaaataatactaaagtcaaaagcccaatctttcattaaaacatcacatgagtgaagaggacagactctggggatgtgcttaaggtggttctaaaaaagtaacggtgttctttataaataacttattattagaatgtaatcctcagagtgccctcagcgcttctcaactacactcaacataaatgaaatctaggagtccacactagcctttctgagataaacatttcggaagacagcgcaaaaagctgggggatatgctaggctctctagagaacctactgttcaatattataatacaaatttttactctattgacctgtttggatgtgtagttctgctgatccaaccgctttaatcctgtttaatatctgggtttcatcctataactatggctttagacaagcatctttgaaaaccaaatttgagggtattagttctttttcctgctttgctactgaatggtttgttaactagcattttattctctgtgcctgctatatttcttagtcatgagagagagagggagtatttatttacaggataaatactttaaagcaccaacccaatatatctatagttaaatgaacatcctaggtattgtttcatatacaaactctctctgctttatactgtttattcattttgcctgtaattgcttattttattattttttttcttatacttttagggatttcagacaatcttagcaatcctcaaattgtcagcatctttttctaagctgctggtgcatcattcatttgacttagtaatattccatcaaatgtcttccaatatcatggaacaaaaggatcaacaggtacagtgtttttcacttgcatcctaaatgttatgtatttatctgactctaattctcatttccactctttttagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtaaatattcaaggcctcacttttgtctttgctcagtattcttatagaatgtaagagccctgccattgtgtatctcttacttatatcatattattcttcactacagaaatttaccagtttattgcaattgtttgtgtcttgtagtagatttatagaattccagaagtaatagggtcctttaggtgttatccagtctaatctttcatttcatctgtttacttatcttgttaagttgataaataacttttcaaatgtgtcccttagtaggcatctctacaacttagtctccagatacactccacataacacatagttctaatgttttgataattttttaaccatttttttccatggttttagtttctttgcctagaaagttctcccctgagggctaccacacatggctatgcaggctgtggatggcacacttttgtcggtgccattcacagtgacatgagttgctgttggccaaagttgtgtaacactggtctttctttccttctctcttccctcctgaaccatgtaaacatatatctatctgattgttctgctctcccttcaaaatataattcaaattatctttctttaaagccctccccatacctccaaacctccaaacaaaattaagatttacttcttttgtcagtctatgaaaatatatacatatctcttgtatacttggtgagttgtgtgaaaataacagtgtacagtgttcatctttgtatcattcagaatatcgagctcattgctttacatatggtgtgtattcaataaatactaggttcattgcttatatttcagatttgtattatttgtataagtgttagagtttatactagcattcaggtagcactatgtctattttctagaaatttaatatttctaacaaagcaattatgtagtgatttaatacacattattaaataatcaataaagtactatgtttgccaatagtttactttttaaaccttactgtatttaatatccctactgtatttaatatcccacttgcctatggattgaaatcaatttgttgactgttaagattaagttaatactaattagtaatcaacataaaaagaaaaagaatttgtaacccattttcatgcattacgtttatgaattaaaatcacataaacaatctaattatttaaatttagtcaaatttcttttaagcaagcaacaattaaaatagttgctccgctttactaaagataattaaatttttccatcaataatttaatacatttttactgtgcatcttttgcatgcagattattgcattaattttaattgaaaataccgaagaactaaaaagaaacttccccttctaagtccacattaaggaaacaacatacctaaaagcacctgatacaactgtactacattccccacaggaaatcatttctactattctttcaatttatccaaatctttctacccaacaggatttttactttattcctctttccatattcttttggacttcatatgcttagttttatcttttctttttaaaacgaaatcttaaatccaaggattatgtattaggtttaaagaatttatcccagttgtcagaggttatttatatctagcaaacaataactgctgattaaatcttgtggatgagtttgtcgtatgtaccttatttgtgccagagcaaaataaggtaatcaggactatttattcatttaccaagaggttacatattgaaggactatctagagcaagggtggagttgtgttagactttctgcagagaatttgataatggaatgtacatgattggtagagaagaatatggaagtttaatactgggtatgcaaatgcatggataaaaacctcaaggtaaaactcatcaaatcacagtggaaaaagtatagtgaagtctgaataaaaataataagaggctgggcatggtggctcacatctgtaatcccaacactttgggatgttgaggtgggaggatcacttgagccaggagttcgagaccaacttgagaaacatagtgagactccatttctacaaaacaaaccaacaagcaaaaaaccatgtatgatggcacacacatgtagtcctagcttcatgcagggtggctcatgcctgtaatcccagggctttgggaagtcaaggcgggaggatcatttgagcccaggagttcaagaccagcctgggcaacatagttagacccccatgtctacaaaaagtcaaaaaattagctgggtatggtggtacctgcttatagtcccagctacttgggagtctgaggtgggaggatgacttgagcctgggaggttgaggctgcagttagctgagattgcaccattgcactccagcctaggcaacagagccagaccctgttaaaataaaataaaataaaataaaataaaataaaataaaataatataataaggctgaggtgggaggatcacttgagcctaggaggtcaaggctgcaggagctaagattgtgccactgtacagcagccttggtgacagagggagactctgtctcaaaaccaaccggtcgggtgcggtggctcacgcctgtaatcccagcactttgggaggccgaggtgggtggatcatgaggtcaggagatcgagaccatcctggctaacccggtgaaaccttgtttctactaaaaaaatacaaaaaattagccaggcgtggtggcaggtgcctgtagtcccagctacttgggaggctgaggcaggagaatggcgtgaacctggaaggcggagcttgcagtgagcctagatcgcgccactgcactgcagcctgggcgacagagtgagactccgtctcaaaaaaaaaaaaaacaaaaaacgaaccaaccaaccaaccaacaaaacaaacaaacaaaaaaccaacaaaaccaaacacttctatcatgctcattaccacctgggcactgctccaaatactttacacaatttaatccttacgacaacctacgaaaaggtccagtaggttctaatgttattcccattgtgcaagtgagaagctgaggcactgagggtttaaataacttgcctaagaacaagctcctggtaacagtgtgaaatctgcctccacagtgcctgctttaatttcttggctacacagcagattcatggtagtggtggtagtggtgttcattttctctaaaataacagtttgaataatttggttttgataatgcactgcatttattataaattagatgatcagagaaagattgcagggataagaaattatgcttttgataatctttagttatattcttaattttcttcattattatttaaatgtaaaaataaatatctgtgagcagtagtattttcctgtcatgaagctgaaattactttcataaatatgtgtgaatattctaaagagaatgactctgtaggatttaaagaaattaattcttatttttgctggcatttatttattttatcagattcactttctcatatatgtctctcttcatggcaccatatgcctaaagtcagcttggatagtttggatcctccaaggaaaattccttccacaaacatgtgcagcacacagtgctagataattaatagagaatataaaatgggtttcctgtttcaagatggtttgtaggtctgtatgtgtagggcattgacaagagagtaaaacataaatcaccttagtacaaagtaaggagtgaatggcatatcttagagaaaaaaaagttactgggctataagagaaggcatttgtgagtttttccctccctccccgcttcccttcccttcccttcccttcccttcccttcccttcccttcccttcccttcccttcccttcccttcccttcccttctcttccctcccctccccttctcttccctcccctcccctcccctcccctcccctcccttctcctttctcttccccttccccttcctcttccccttccccttctccttccttccttccttccttcctcttccacctgccttccttttaattttgctatgagcccttaaagaggattttagtaatttgctacttaaattaaatatatttgctagatgttgtgctaggcttcaggaatacaagttggattgcagtaatgtaaagccctttgcattctagcaagaaaacagatgggtatgtatgtttgctcagtgctacattaaatgaaatggatgggagccgggaggagaaatggtgtgtttggcctgagaggttagtagcaaggacttctctgcaagaaagtttgaagccaattcttcaagaatgaacacctttttgctgggtgaaaagtagaggaaggcatttggggtaatagaaatagcataaaaggtaatgaggtttgaaaaattacatgctgtgtttggaagaatgtcctggagcagcagcgttttagaaggtttttaaagacgatggtgacttgatcagagctctgtagtgctttgaggatgggttgaaggtgggcgtacttggagactggtgggcatttaattggtgccttccaaccacataaatgaatgtcccctcaaatcccttggaaacactttaattctagaaaattcaaaaattgtccccaacatctttttcctctgagttggtaccctggatctttgggtcttcttttctttccttttttgatgttttattttgggtaatgaaagtcacacaggttttgaagccagcagatttggcttcaaatccaagtctcagttgcttgctagctgtaagggacaaattatatatcttttctaaatactcatctataaaatgggagtaataattgctatggcataggatttttttaaaaaaaagattagaaatcatgtgtgtacagaatttagcacagtaactgatggatattatttctattacctgttatcttggtcttctagttgatagctccttgctagcgtctagctcctttccatagctcttcctgagtagggccagcatgcagtgccacagcttgctaaggcttctcctggattgctgagttgttctagtttttgtggcacctcacatgctaacccaccctgaacacatgctctgaaaacataacatttagaggaaggttgaagactgagagacaaggtatatctttgaggaaattcagatgcttgtcttgaggagctcaggaaagctagacacgagtaatgactgtcgtttgtgtgtggcattaataaattttacaatagctatgtccccatttagttattctatgtcacaaataaaggcaggacagtagtatttactgtgttaaggtactggtttcccaggtatcttacagtgagaagacagaagctcagaaagtgtaagcaatgtgcatatttggtggagtctggatgtaaacagagatcttgatgccaagcctgtggagctttgtctccatataatgttgtctctttcataataactgactgtcatgtggcagattattcatgctattctgacattgatggcattaatatcatcttattttcccaatctattcaaggatcagttttgccttattttattttgtttcattccaaattggagatgtagagaaaaatcacatgaagtttgatttgccagtctcctaaaaggaagaaaaatgtagatttttaatatacttaattttttttctttaataggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaagtaagtaacaaggagaatattttttacaattcttatttttaatagtatttttttaagtcactagtcttttagtggttattcatgccagtttgagggaccttaagccaaagatattgcaaaggtttggattttttttttttttggctatgaaatacttcaaaatgacatttaagttctttatgagatagcaaatagttatttataaaaatagagcaaaatagtggaagctttttgaaggggtactttttaatatatattttttattattaaagtaagatatccctgtttttaaaggaaatataaaattataaaaaagaaaataaaaataacttattttatctcttataagtaattaatatggatatttttcctaactttttatatgcttacatgtacctatgcattcaaatgtatgtaaaagcatacacacatatttatttggcatttttaacttagaatatactttatatttcaattgataatgcattttctttatactttcaagctcatgtgtattttgtacatattatgtgtattgatggtaagttaccatcttctgacactatttttatcttttgagctctctcatttgttcacactaaatgtgtttttagcgtgaaagctcccagctttccctgtgttaacttagtcccatgcccatctccttccccatggtcatcaaactccatgaatcaacaccttaaggaccatcttgcaagtaacatgtttgcttctctcatttttatgatgcactcactagcaaaacaccagttttggtcagtctaccagtctactttttccctcagtttcaccaagaaaactgagtgctgctagagaaaagtacccatccatgcaatttggtgcctttatacatcaaggtttccaaccgctcagtaggctccaaaagttccaatcaggctgaattttcctcggtttctcaaacacttcgtgtacccttacttccagtctttttccagtgttactctctctctacctagctctaaattctctcttcacctggctgtctcttcattcttcctgtctcagtgctatcaccagtctggaaggttctcttacatgaccctatagcactttatttctcacatatactaccattcaccacattatataatttaatttttcatttttataatctactttttggtaaattgttagtaccatgaagtcaatgtcaattttgttcatggttgtaaccttaccattgatactagtgttttgcacatagtagattatcatttagaattaagtattcaatattggcaaaaaataaaaattgtgtaatacattatgttgataagcatgtgtggaaacatgcttcatatattgatatgaatttaaattgtcctcttttgaggacaatttggcaatatctactaatatttttaatatatgtacatacttttttgacctcacaatgtactgttaggaatctatgatacagacattctcaatgtgcacaaaaattatgtacaaaaatgcacattaaaacattgtttataatagcaaaagagtaggaaaaaaacctaagtattccccaaaaggaactattcaaataaataatggtacatacatgttgtggaatgctttgcaatcattgaggaaaaaaaaacgtggagcaaatttaatgtcctgataaagattacattactccgtggcaaaaaaaagggcacagacagtgtttttactatgctaatgttgatgaaaatgcaactggaatatgatagttataaaagtttgaatatgaaataaaaccctccagaaatgggttccctggttgtctctgggtctttggaaattactgagacatggttagatcccatgtttcattacttaaactagtcttatgccaaaaacctgcttactttaatcttcaatatccgatggagaggaattgtgggcccattggagagggacagagggagatttatcattcactatattctctttgttctgtctggagtttttaccattgacacatcttacccagttaaaaaaacatagaattgtcatttgattaattggagggtataaccatgatttcactggcagctggtctgagtaaagaacactttgggtcatagctttcaaacatttttcaggtagtatttgcctaagtgacatatttgtgtgtgagctcatcctaccgggcttcgggataatttcccatatcataacatattactctggaaaaaggaaccatttgggtatatgggtatagtgtaagccatagtatcagttgccttcttggggtttatcatatgggtccaccacatatttacagtaggaatagatgtagatacatgagcatacttcactctgctactataattattgctattcctactgttgtcaaagtcttttagctgattatctacacttcacaggggtaatatcaaatgatcccccaccatgctctgagccccagggtttattttcctttttacagtaggaggcctaaccagcattgtattagccaactcatcactggatattgtactacatgatacagcagtatcatgtagtaatatttgaagtcattacagtagtaatatttgaagaaatcttcctggctgtatgtagaacaatgaggactcagccaacttattcttcatagtagagctaatacataatgtaatgaagttgtgagaagaatgttaactttgaaattccatcaggtttcccaatagtcataatgaatcactcagcaaactttataaaaataacaagatcctttatttagcagtttatgtgttctatgcattgtgctaaacattttatatgcatcatttcaattactctttttcatcaccatatactgtatttattatcatcttcattttccaggtgaggacactgatacccagggagctcatataactcacaaatggcatttctatgacttgaacacaggcctgtctggcttcaaagcctaggccttttcctgaataaagttagttccatagagattcagttttgctgtctacatgaaagcattgtgtacatggttatgtttttttaaaaaatatatgatctgccacctgttaattattcaggatcactagtgtaaggtgactttgaaaggaaaaatagaaatattctccagaagcatagcaatacgtaagaactttggtcctatgtatgtttatttttgcataattgttgatttctaagttgctggtgtatctcttattttcagatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggtatttattataaaaaaaaaccctttatgctttatatttacacactgacattgaacaataggacccaagacaaaaacctgacctaaatcatctggaaaaacttgagtagaaatgtgtttattatcgcaaacagttaagtttactaattttggttaaagtgatgggtcaaggaagtgtgtctctgtgcttctaaatgttatactaattggttaatggttaatattccaggaaacaaactctgactagactggaacgagattccacgctctgtcattgactagatcctttcgtggcttgtgtaagccccttaaccttgttaaaggtagtaatgtcgactttgcagggttatacataataattagaaaaaatgtatgtaaaatgtctgcaacaatgcttggcaaacaggaagcgcttaataaaaaaggtttttatctttactatagcttaaaacaatattaatattttaatagctcacttgagataactttttaaaaaattaatatggtgaaatatataatgacaatgattagggctgatgtatttagcattagcagtttggtaaaaatggagtgaggggctttcttattaatatagtatgattgaaaacactgggtgatagaataaggatatttgagagggcaaaaaatgagagttgttccaaaatattgtgtctcaagtcaaaccatttttaaaaatcaagtgtagtgatttatatacatatataatttatataaaataaaatgcattcactttaagtatatattttcatgcgctttgaaaattaacatattcatgtggtcattgtcgctattaagttatgcaatattttcattatccaaaaaagtttcttcatgcctcttcactgaaaacatccccttcccctggcccccctgacccttagcaatcatttgcttcctgacaatgtagattaatgttttctctagttttatatacataggatcatacagtgagtactcttttgtgtctgttttccaaaatgattgtactatgttctacccccaccagcagtacatgagcattctggttgctctacatccttgtcagtacttggtattttcaagttacttttagctgttctagtggaggtttaattcatttagatgtaattttcatttccctgatgactaattatgtagaggatgttttcatgttcttattggccattcttatttttgtgtgaagtgttgaagtattttgcttttaattgggttgtcttattatataagagttctttgtatattctagatagaagttgtgacaggtatatgtattgcatatttttttcccagtcatagcttgtcttttcattttactaattctatttttaacaaaacagaggttttaaatcttggtgaaatgcagttttccagtttttttcttttatggtttgtgctttttgtatcccacttaagaaaccttttcttagcctaaatttgtgaatattttctcccatattttctcttagaagtgttaaaatctcagctttggcatttaggtctaaaacattttaagttgatttttgtgtgtggtgtgtcaatgaagagttgacatttatttctttctgtatggatatccagttgttccaacattacttgttgaaaatattatataattcctcattgaattaatggaagctttgttctctttaattgactatttaggtatggttctattttagcattatttattctgtgccactgatttataccttattcttatgccaataccacactgtcttgattactctagcttaatagcagttcttgaaatcagatagtgtaagtcctctggtgttcttttaaaaaaaattgttcttattattctaggttctttgcatttccatataaatttttaatcaactaactttatgctgggatttttattgtaattaagtccatatttagattttatatagaatttatttataaattaaatcatattacctatgattttaatgtaatctataatatataattaatacataaataataatttatatagattatatctataaattaatttgagggaactaatatattaataatgagtcttttgacatattaatgtgatatatagttcaattagtcttttaaaatttctaacagtgtgttgtattggatgttttctgatactattatagatggtattgtatttgaattctaatttccagtagttcactgttgatatatagaaacataattcatttatttgtacatgaattttgtatcctgtaaacttactaagctcacttacgtgttccagtaccttattatagattctacaggattttctttgttcacaattataccatttggtaataaagacagatttgctttttcttttctaatatttatgtcttctttttttttcttgtcctattgcactggctaggacctccagtactatgttgaatagaattggtcagactgggcatcattccctggtttccaaacttagaggaaaaacatacagtctctaatcactaattatgacattatctgtagtttttcatagatgcccttcatcaaattgaagaagcttcttcctagtcatttttggagagcctttttttatcattaataggtgttgaaaaatgctcttcagcatctgctgaggtattcatatttttcacctttattttgttaatatggtcaaatacactgactgattttctaatgttaaaccaacttgcattcctggagtaaatctcacttggttatggtacattatcctttttatatagtattaaattttgttttctaaattttgttaagaattttgcatctgtgagagatattagtctgtagttttatacttccttgtaattatgggagtaatgctggcctcttgaaatgaattgggaagtgtttcccattccacaattttctggaagaatttgtgtaaaggtattttcttcttaaatgtctgatagacttcaccagcaaaggccatctaggttttaaatttttgtgaggaggagatttagaattatgaatttaataactttgatagatgtatgattattttaattttcttttacttcttaagtcagttttagtaatgtgtaactttcaaggaatatgcccatttcatataagttgccaaatttatttgtttaatgttacttatagcaattatttaattatcctgttagtgatttaattatcctgttaatctcttcaaagaatcagatttttgttatattgattttctctattgtttgtgttactttctcacggacttttgttcttatctttattgttcccttttccttacttatttttattttaattgactctttttatagattcttaatttggaagcttagaacactggtttttagaaccttcttattttgtaacagaaacatttatttaaggctgtatatgtccttataaatatcactttcactgcatcccaatattttgatgtgtcctctttctattcatttaaaaaaatttaatttcccaaatgtccaacaatgatagactggattaagaaaatgtggcacatgtacaccatggaatactatgcagccataaaaaatgatgagttcatgtcctttgtagggacatggatgaagctggaaaccatcgttctcagcaaactattgcaaggacaaaaaaccaaacaccgcatgttctcactcataggtgggaattgaacaatgagaacacttggacacaggaaggggaacatcacacaccagggcctgttgtggggtggggggaagggggagggatagcattaggagatacacctaatgtaaatgaggagttaatgggtgcagcacaccagcatggcacatgtatacatatgtaacaaacctgcatgttgtgcatgtgtaccctagaacttaaagtataataaaatatatatatatatatataaatttaatttcctttgtgacttctttgattcacgagttatttagaaggctgtcatttattttccaaatatttggagattttctggataactttctggttattggtttcagtttgacttttttgtgctcagataacctactctgatgatttctatccttttatatttattgaaacatgctttatggattatcatatggtctgtcttggtgatgtgccatgtgcaactgaaaagaaagtatattcagctgttattgggtcaaatcaataggccaaattgtttggtaggatttctcaagttttctgtgacttcactgacttttctttctatttattgtatttgatagagaaatattgaagttgtaattgaggatttgttggttgccttttcagttttatctgtttatgctttgtatattttgaagctctgttgtttgttgtgcaaacattaaggactatataacaaaggactatatataaaaataattttttaaataaagtaaccactttatattaatctaagtttgcagttagtatcattttcttcctctggaagaattcccttttacatttctagcgcagatcttccagaaacccatatgcagattactggagcactttttccataactgccccagaactcccagctatctcagtctccataaatgttgatctctatctcctcatctcaggaaagccatgagactgtttaaatttcttcttatgtatatggcccttaatttgtctctaagcagaaggccagagtgatcatagggctcacataatttgtttcccttctttcgggtattacatagtcctatgctgtctgttgcccagtgtctgtatccagtcatttaatatatttatccagttttcttgttgtttatgtgagtaggttaagttcacatttgttactctatcatgcctgaaagaactctcttcaagtatttttcaagaaaacattagaaattttaacataaaataattataaaatgcactatgctgcttgtacaaataatgtgctaatagacatttcacacacatataaagtgggataattatgataatttaataatctttataattatgtaattgttactaaattataaattatattttattaaaattcttaagcattaaaataatttaaactatagaattaattaaactttagcaatgaaccaggcaggaactgtttatatcaggatttatactgaatattataagggtggtatttggatatacagattttataatttggttttgacataaaatgaattctttctttttctaagataaagagtaggggaatttaaaatcataattaatttttcacaaatgcattcacattatttatctttaatatgatttttttattgatctttgttttcttgtaaatttattattttgaaagtactgccttttccttattttataaaacaattattgccagccaaatttattgtgtttattttaataccattccataaaagaaaccatgaaacatgaaattcaaatagaaatttattaaaaattgctgactgttaaataatttgtgtgattacaacatttaaagcaagatttgaaaaatttataagaaaaattcagggagttaatccactctctttcctatgctgctagaccctattccagcggtctccataaaaaaaattcagagaaacagaaagcagtaacagtgatcagattgcatacaaactttctgcacacacatatatttgttataacttatgtaaccgttgattgatttggctttttcctgctggactatgagctcctctgaggaatagatttattttttttctgcatatcagtatcccgtgcttacccagtgtctagtctgtaacagccattctataaatatttatgggtgaagaaaaatgttgttgaatttttaaagtgaaaaaccaacatggcttatcatctctattttaaagattttacaaagggaatggactgtgaaatttccattaataaaaataggtctaatcttccatgattgaactatgatagaaggatcttatgattgagtaagctttttgtattcaccttcatgttattttatcattttcaaaataggaagtgaaggctcatttcttgtgaaaaagaaatctaattcaattagtgtaggagaattttaccgagatgccgtattacagcgttgctcaccaaatttgcaaagacattccaattccttggtaagttaaattgtgcaattgtgattatgttgtgttttgctgctgacattctcttgataactaaaatttatgccaaagctaggaacaattggtagggatttccctgatgtatgaaaactataattttgagatttttatatatgtaatagatatgaaaacatattagatgtaaattatgctcaattcacatttgtagtcttttgagtatgcagggtatgaattttttggggcacatatatatatatatatatacttacagtacacttcaagatggttttcttctttcttttcagaactccatgtctgaaaagagcccaggctagacctctacctaatggtgtgggttggtcccatgaacactttagctagaaatctgatagtgatttctaagaaaccagacagaagtctgaaggacactgaacaagatggagtagcataatataattcattgttcatctatctatctatcatctatctatctatctatctatctatctatctatctatctatctatcatctatctatcaatcatctatctattttggtgtattgaaagtcatttaattttttagatacctttattattatttcaacctcttgtctgttttggaactatggaaggactatggcatatttgcatgaggagtctgataattctagttgaggaaattgggagccaccttattctcaggttcactttgaaagacctgttctaacctattctccaattttgattatagctgagtactaaaaatatgagggttgttttgtgttaattctagatcttaagatgggtgaaatgaatgactgtagttgaatcggttaaattagctgtcagtctttatatgctctttcgaatttatatataaatttagttataaaaagtagtttggttaatgagaaattatatggatatagctttttcactcaacctttctgtttttcagtttccttatatttaaaacaaaggagaaagagtagatgctttctaaggtcatttgagcactgaactggagttttcttttatcctcataattgggttcttagtttttacttgcctattttttcccataattataaataccattaaccctattaaaatttcatggttccttccttataaaaatgtcctcttctccaataaatgacagcaattttattataaattattttttaataggggcccatttttgatcatgaagatttactgaagcgaaaaagaaaaatattatcttcagatgattcactcagtaagtatttggatgtaatcataagtaaatagatattttgggcagaatgcagtgtttggttgaatttcctccaattattcaaatattcttggtgccagtttcatcttacataatcttcatatatatttacctaatgattccttccataagctatagaaaaatgaaacatacatttaaaaatttacctttcttgaatattatagaacacattagtctttttttttacaagttttctgaaatgtaaataacacctccaccaaggccactcttcatcctctcctccagttttctttctttcttttttttttcacaccacttacaccacctgattaaatgctttttatttactgttcatctctgccactggaatgtaaactccatagtttggttttctactgaatcttcagtgccttgaagaaagcctgattgctaggaggtgctcactaaacttttactacatgaatttaaattatttgcttatatttccattgtttgtttgtttttgacaaaagggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaagtaaatttaatttatccttgtaactttcaagacatttgaagagcttttgtatttatatctaatttgcataattaagtcgtttaaaagaacattctacttttgtgtcactgggtgataagtcccccgtgcctctggtttttgcacacatatcttagtctgtgtgatgttcaggagcatctttgagggcaggcaatggaaacagatctgattagaaaggaattccaggttctgtacggagtacatgttaaagtctgtcaagtgtatattgattatactttaatcatttaattcaagtaagacaacttcaacaatttaaattagattaggtaaactagaattagacctggtttggtagtactggctctgactcagctaccaactgtgtgacaatatgaacatgtcactccgcctgctctaatccttcattttctcatctgtgaaatagagattcaactaaatgattactgaaagtttttttttcagtttaaaataatgtgtaacttaaagatttttttctttttggtcaaagttcctgtcttgtaagaattaaagtataacatagtttgttgataggatagctctctgaaaattgactttgctcaccatttgtatgtactacagatcaaaatagttttgaaagccaaagaagatatcataaaagttaaaattattttaatgcaaatgtttaaattgttaaattctcaaggctgggcatggtgactcatgcctataatcccagcactttgggaggctgaggcgggtggatctttttgagttcaggagttcaagaccagcttaagcatcagcaaaatcctgtctctaccaaaaatatgaaaaattagccaggtgtggtggggtgcacctgtggtcccagctacttgggatgctgaggtgggaggattgcctgatcctgggaggcagaggttgcagtgagccaagatcgcaccactgtactctagcctgggcaacagagtgagaccctgtctcaaaaaaaaaaaagtcttgttgcaaatgcatttccccctttttaagcctaaaaaattaatcataattttgagatgttttaaaggcaacattacataaattttaagtatatttaagggatgttttttctctaaagtttttatatctggagacagagagaagaaagaaaggtgacccactcctccagccatgccctaatgtctaaaatgtgtctttctctcttctccacttctttgccttgctaaatacttcaagccacccagggctcaatttaactgtcacttcatcactctctgcttctcttcctttttccttctaccctccagccaacctacccacctagcctccatgtccataacacctgatgctttccacctaattctcattcggtcatccaatttgatttaaaatacctttgcccccactagactgtgaactctttgaggacaggacttgtttcaggcttgtttctgtctattcccagtgcctagtgagatctgacatatggtagaagtttagtacttactgaattgatttgtggaggaataaatgtctgaaacttggtaatccttcaattaatatttgttaaatgagcaagcaaaataattttgggatttagtctagttaaaacaaagagaattggaagagactgtgacaaggtgagacatgccggcattcaatgactggacaagctcagaaccttctcttagggaaatttcaaaatgacaccattagatggcactttgtttgtttgtttgttattgtcaaagggtctcatctatgttccttttataggaacatttcctgattaaaccttgggaataattttaaaatctttacttcagaataagttaatgagggtctgaaacaaaagcaggaattttgaaacaacttctggggctaagagtggttaataagcctctataatgatatcaaactctagagtttctcgtgtggataaatatattgataaataaagaagaccatagagaagtgattgattttggtattttagctctttgagagtattacgtacctaagttttaaaaaattgacataatgtgtaagtaggggtttgctattatcattataaaattagaaattgcttaaaaatagaaagtagaaatttgaaacaaaaagtttcgtaaaaaacaggaggttctaaaatgaaacacattataagtaactatttttatagttaaatcttaaatatatcaaaatatgtaaaatttctgacagcatttaaaacatattcccaggattatattgtactttttgttaaatcattaattcaaatatttgttgaggcgtattctgcttccattttgctctttctggaaataatttacaaaaaagctgaaggaagctttcaactctatttttgtgaacctgctttttacaatctacctgttgtaattttcctggttttacccatgctacaagcagagacgattgggccaattagtatactgaaattctgttgtggattgtgttttcaactttttgaaaattcttgatggttctagttaccagaggtgtgtaaggcagaaatattagctagacttaagttcctcagatggttcactttagaattttaaactattgtcttttcagactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaagggtaagaaagagctcattaaaaataaaagggttgcctaaatatgctgatgttaacaaaatatgctgacatttttatagcaatgagttttaacaacatggtgaaactccatctctactaaaaatacaaaaattagcccagcgtggtggtgcgcaccttataatcccagctactcagaggctgaggcatgagaatcgcttgaacccaggaggcggaggtcgcagtgagccgagatcgtgccattgcactccagcctgggtgacagaggcgagactctgtctcaaagaaatatatatatatatatatataatatatgtattataatatataatacatatattatatatatttattatatataatacctatatattatatatatactatatataatacttattatatatatactatatataatacttattatatatataataaaagaccgaggcaatgaatattacaacttttatcaactgacttacatttttacaactaatttttaaattaatgagtcctctttgatgctgttctttgaaagcaaattgtttttgatattttttctttaaagcatatgaatttatgcaatttaatcattatcttgtctcttgtgactagaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcatatatggaccctttagttgtggatttaaaagtggcatttcagtttaaatattatgctggatttaaaaaataaaattagcaggttggcaataaaacaaaatgctataaaactatgaaaagacatgaaagaaacataaatgcatattggtaagtgaaagaagccaatctgaaaaggctacatactattcgttcccaactataagacattctggaagagacaaaattatgaggacattaaaaagatcaatggttgtcaggggttaggggagggagagatgaatagataaaggacagaggatttttagggcagtgaaactgttttgtatactatagagggggatatgtgccatggtacacttgtcaaaacccatagaatgtgcagtataaagaatgaaccctgatgtaaactatggactttgagtgataatggtgtgtcaaatattggctcattgattggaacaactgtgccaaactaatgcaaattgttaataataggggaaaatgtgtgtggggtggtggtggtggtgagggaagaagggatttattgaaagtctctggactgtgtgctcaattttcctgtgtatctaaagctgccctaaaaatagtctataatttaaaaaaattatcacatttttattgtcagaggttaaaatgatagttacttggcctactgtgtagtaccctgtggttccctttagtcttaaactaaacatgcacatggctgcctgagctgggtaaggcatcctgatactgagatattgtttttcatactgaagtttcttcagcaactttttgtatgataaatatgattactctttgctgttgttagaaataaaattaatcatttaatggttttcaaattagtgaagttaatgtatattcattcagctcttgtgctttgcaagacattataataatgcaaattattatcatcacttttattaaaagttgtagaatcccctgccttctcttagcatatgaaataatagaggaaattatgttcatttgtatcctaaatgaacattttaattttaaggaacaaaatacttttatgacaataaacaggaattccccatattttatcttccttcatagagaatactcacatcttgccacccatgtgtttattctatacctgactcagtaaaataatttttaattctatttaatagcagaatatggcttaactacttattaatagtattttaatttgtcagagctttcagaaactaataatgatcaaagccatcttaatttggatagtattttcctccttttccgcgccctcccttcctcctaccctcctgaatattggccactttccaaccatgatcttgaaactggggatagagttgttgactcactcactagtaagcaaagcaaactcggtctctgtccttaaggaacttgtgattaagttcagagcacagacaaacattaagtaatgatggcataaataaatgtaattttatattgtggtgccttctgtggaaaagtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacaggtgcatacaattaattatcttgttgtgaaagtttgaatggaccccagttcaaaatctgtttgctttgcactacacaatcttaatagtttgagaagtggtcttacatttgagaagatgccccatggaggtgacatctgagcaggaccactaaccattaaaaaataatcccatgtaaatggtgaaaccctgtctctactaaaaatacaaaaattagctgggtgtggtggcgtgtgactataatcccagctactcgggaggctgaggcagaagaatcgcttgaaccagggagtcagaggttgcagtgagtggagatcaggccacagcactccagcctggcgacagagcaagactccgtcaatcaatcaatcaaacaatcaataaatcccatgtaaaataaagttttagttctgtggccttatgagtgttttccatacagcatatgaaactcaagactctgaagtcttaagtggagaatcatttcgattcatttattttgcgaataggtgaggtataatagctatctttctgcttctcaggaagacagcttctaggagtgtcctggaacattttgacccttgaagattgtctagataaagaataacccatatttttaaccttgaaaatgctaataactaattcctcaatccgttttcctagaaacggtagatttgtagatctctcaagtgtcttagtgttcatctgatctagctacactcttttacagataagaaaagagactgtgtgattttctgtttcccaaattgtgtttcacagaattttatttcttggaggtacctcatactgcatttccttcttaacaattcataaagtaggccaggcacggtggctcatgcctgtaatcccagcactttgggaggccggggcgggcagatcacaaggtcaggagatggagaccatcctggctaacatggtgaaaccccatctctactaaaaatacagaaaattagctggacatgatggcacctgcctgtaatcccagctactcaggaggctgaggcaggagaatctcttgaacctgggaggcggagattgcattgagctgagatcacgctactgcactccagcctgggcaacagagcgagactctgtctcaaataacaataataataataaaataataaaaaataaaaaaatcataaaatataccagagtattgagaactcagatattttactttattttactgaatgtttcccaatctcttaagattatatgatcgaagaatacttttattaaataacacccattattattccatagaacactctttatgagctagtaccataaagaatttttgtccttataatatactgtattttagtaaagtgttcatagttgttttgctatagttatttaagagtaattctagttaatctatatggtatataataacatcacacataatttgaaatgaatattctaggaatttttactttgtacaaatgttgggtagacaaatttatatttaaatagctgtttagcttccaggttaaaaggttctggtaagtatagcatattattttattgtttagtggaagtattaaggctattaccttatttttaaaagtggatttttaaaaattgtcagtgtgagaatggaaatcaaattaagtgacacactattggtagctgttcttatttttgaatttaatggaaatctggttaaaatgattaaaatgtttatctcattttttttcttttagctgctatgcctttcttgcctccttctatgacaatcctaaaattatctcagaacaaattttcctgtattccagaagcaattttaaatcttccacagtaagtttattgttattttaattttaaaagcacattagctggaacagaacctttagaaacatgatttcgatttagtcatatagaggtaattgatttctaaacctactcaacttgatgtttttgtatgtatgaatgattttcactagataaaagacccaactcattacttaaaatggaaacttttatatttatttagtggatcattgtgtaaaaacaacttaagattgtttaattaattgctgtattagtataatgaaatgagattatactggctatcactttaacttttaaaattttaattgtttgtggaacttgatatgttgccaaaatacccttaactttcacattatgcttaagttatgtttgagtgaaattttgggggaagattaggcaagtttatgtagttccaggtttttgagatattttggttaattcatgaaaccagaagcttcctgttaactttaaattcaggcattaattggatcttgagtgtgttgtaatcttaaatgctattctaattatatcatacatgataaaccaaattcataaaaatatatgtgtaaatttatcttttcctttgttttcttgctgtcagctattccttcaaacactatggctttttagaattgacactaaaatgctgcttgcatgatgctgcaatgagctcttctgtgagcttatatttaggcaaataataattagaatttagccatagagagtgttacacaaacctataatagctaaattacgtctagctttagaatgtgtttaactgttctaactactctacagcggttcatctctttaatcttcctaataatgccctacgatagccactgttattatctccacttcataagagatgaagtaacttgcccagagtcatagttcttaaacactggtggttcaacttcaggctctcaaatcacatgcatactcatatgtcaataatgctagttttgacgttacactttattctcaccctggggaaaattatttgtgatgttatttcatgtattttggaaatactcatttggtttatgtcttttctgtgtattgttttagcttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctcaagttgttactggcctgtatactgtattacttgtttttcagctttccttggtacattcttaaatttctgcattccgccaccatgctatcaccctaatggatcaaccttttttgttttgctccattctctctgttgtaaatctgaaattgataatttgtttgtctcagaaaatattatttttcaagttctagcgtattgcctacaaaaaccaaaagaattaagtgtctgacactgtgaggttcagcaaaactgtgcatatattttgctacctgattttttgccagcaaatgagtgttttctattataaatatagtatatattgcttaaaaatttggaacagaaaagaaattactccaattaggatgccacctaaagtataagcatgtagctgtactttgagaacactaaattgcatgcaggtttgtagtgactaggtcttcttgcctttactgaaggagcagaatgaagtcacagataatggataaccaaatccattttgtggtaagaacttccttactttcaatgtcttgaagagatgaagtatgttaccaaaggagattgggttttttaatattacagatgagtgacatagattgtttgggagtaagtttttatatgtaagtttttatgtttttaaacacatactgacaacttatgacaaacctttggaaagttttaaaactctgttgaaaggttgtgcaagctgctgatggaatctgtgagcctttcttgtttcttatcacgttttttggcagagcacatttcttccttcccaccaacaggttttgcccttttttttcccattaagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggttagataatttttttctatttggttttactaaatttatttcagattttctactctctgtgactttgatggacatatattgttactatttagggaaaaataaatagtaatatttggcattaatatgctgtgtgtcatttgcctttcatttaatgaatgtgtttctgtggtgccactgtagagatttctcattcttcttagccagactaatgttgagagcggcttctcctccttctgtttcttttcagtggagtagactctaaaagaaaataagtattgctatttggtctctggttaccaattacacaatctaaagaaatacagcacagtataataacttctcacactgtatttcatatagcaactagttaacatatgcctcttacatcttaaagcattatagctactgacatcatgtgaaattactaacttctattttgcccattaggatgagtaatctactcaccttgatcagttttgaaagcaccaaaacttctcaagtatcactgtttctggtctttacactttaagcactttaaatatctttggtaatggattttatcctcctttttgttccctttcagcacatcggtcttattactttctcataaaatcctttgctcccttttccacagttactgtattaacgttgcagacctcagctctgtcatcacctctcaacttgactgtaatatccaccaaggcagagaccatggctgtgttcactcactattcaaatcttggcacccaacacagtgcctggcatacaattaatagttgtttaattaccagtgatttatacttactcattctcttctgcctaaaatctcttaaatttatatttaacttcatctgtttttatgaggaaggattttgttttctgaactcctgagcttgatttcattttaaaggagtttgttatcttttgtgctaattgtggctacccttcatcctacccaattatttttctctcttgaaactggaaaagatggtcatataaaaattggttcagttcttactaaacatttagtagaactagctttcagtgtattatactgtattatctaactaaatatttttaatatttaatatttaatttaatatataactaaatatttttaaacatgtttaacattttcagaaaagacagaaagacctagagcagattagaaattgtaggcatcatttgctttttgaagaaagacattttttcaaatagtggtgcattcttaagaaataaatcaagaaaggtaatgttgctttttggtcatatcatcaggaatgttggtcagattcttattagttacaggaatgaattgatcactactctgatgtaaaattcacttatgatttagtctttttctctaatttgaaactgtggcaacattttaacatatttcaaaatatatctttctctatccattatatttttgataacactttgactctactattagtttaaaggtggttttttagctacctaaacacttctatttcattcaggttttacattaagatcattaggaatgaaagctaacatctgctgatagtataatagtttatatttatttatgatgttatgtgatctcactatccatatatactattatatgcatatgtgatatacatgaatatatagctatacatcatatataccatatatgaatatatacacacacatatataatgtaactaatatgaccctattatcaagctttaacagtatacatatatctctaccttgtttctatgtcatatggactttgtgaaattttgaactttataatttatagggtttttcttttcttttcttttctttttttttttttttttgagactgagtttcactcttgtcacccaggctggagtgcagtggcctgatcttggctcactgcaacctctgcctcttggcttcaggcgattctcctgcctcaacctcccaagtagctggaattacaggcacctgccactgttcccggctactttttggatttttaatagagacggggtttcactatattggccaggctggtctcaaactcctgacctcatgatccgcccacctcggcctcccaaaatgcagggattacaggtgcgagccaccgcacctggcgtataatttgtagggtttttcatactatttaaagacattagaatatgtatacatgtatgtatatgtgtgtatatatagaggtatatatatattgcatatcgtattctaattagtattgcaaacatattttggccttttgattatttctggtgatagtgtaacatgttttctttggtgattttaccaaacattatcaactaccctaaaatctctagcaaaatatatgcattaacagtactctgaaagacatgtacattattagttatatgagatatgcactcttctggatactatattttagaatagtgtgacatgtaaaagaactcacctaaatctcaagtatacttttaagcagtttattattttatttttatctttcaaatactaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtatttctttctatagaattttaaaattcacttttaccatttgtttggaacagggattcaaaaactgagctttctgttctaatatccagaaacctggtagactgtatggaattattccaaagcccttcatttctcctaattttacccttgcctccagaatggagaagaacatggagggatatgttaggaacaatttggtgctaggtactttgatcggttgctgacaaatatgctaaaagtggtcaatcctagtaaaaacccagaatagttctctaaacatggtctgttgtttttctcttattagtatgctaaataataaatagtattattctcccagatttttttttaaaaaaggattcttgcctgtcgtttgaaagattaaaaaaatttgtctctaatctttatttaggtcgtgaggaattctatagtactcatccccattttatgacgcagcgagcattgtaccttgctgtctatgacctcagcaagggacaggctgaagttgatgccatgaagccttggctcttcaatataaaggtgatttgttctgatcatttgaaaatagaaaataattcatgtgtctgtgtgcgtgtgtgtgtgtgtgtgtaagttaatttattttgggcaaacaattgcttcagtctctttaaatactttcttaaaagaagcactaaaattttgaattgggaaactttccgagtaatgaagtcataacatgaaaattgtatgttccatgttggtgaatgttattggtaacctgaaactcttttatgctgtaaaacttgaaaatatatatgttcaactgttttttaattatattatttcttaaatgaaatctaaatttttctaatttaaaataagctatattaaagaaaagcaatctatatatatatatctcatcaactttgtactcaggggccatttagtgtgaaattcttcagattgtatcctttaagtggtcccagattattatgctgttacatctggaatctcccttttgttgcttttctatcttttcctttgttgtcttgttgtcagctattccttcaaacactatggctttttagaatggagactaaactgctgcttgcatgatgctgcaatgaactcttctgtgcataaagtccttaaaaagcttgtgtcaggacatttaaccatgtaattggctgcatacatgcttgttttgtaatttgggtattttttaatgtttcttttattaacttttttacagctagccaacgtgagcaaatagtacagtggcagtcatatttgcttgagtggcttttattctttcattgtagactccaaattggttgactttaaaacgaatttagaagattaaattcacagataaggaagagaaaatataaactatatgacgttaatttgatataatttgtgggtttatgaaatgcttattttatttaggagtgaataactcatcttaaggcatgaagatgggaaaggaaaactataccactaccgttatatatgccacctaaaagggtgaagaattgggttaagaaaggccaaaaatgactttttaaaatgtcgtaaggttacatttttttcttaggtttaaggaaaaaaggacagttgttcttttcttcttctgaagtctgctagtttctcttttccattcaagtgaatgtcacggaaagcaaatatcaacaggaatgtgagcaggcccagtttgaaagcaaacacaagagggttttgtgtctttccctccaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaaggtaacatggtaggctggtagagaaatgtaatttattgattctcaactgcctagaaatgtcagaaattttgagaagtgagcaactcacttaaaattgtgggttttctttccttgttgctgttagcattattaaagtcctttccattttaaaattatttatgccagacttcatttctaattcatagaaatgggaacaaaaaataattagaggaacctgagagaaactaagagaccgtttctgggatactgagaaaatgtttctgagagagaatctgagaaaatgtttttgatgccttttctgattcaacttcttatagtggtgattcaatcacaagggtaaaggtgaatactgaggtcttgggatcatctttcttctattattctttaactgttatttttccatttcctcttttcttttggaattcctgttttatggacatcttgatcttttgtgccactcattcatgaattttgtcactgtgattcccattccaatttttttccctccgtattgtgaggcagctgttttatttagtcatgaagaccactaacttggttttcagcagtgtctcactaattacttagttcatacaaaatgggctttttattttaggaattatgttttaaatgtttaaagttatcttctcgtaagccaaatttttataaaatgtaaataaatcagttatcagagagaacacttttttttttaaatacttggcagaaaaaagaaatcttcactgggtactacagggagtgtggtgtaaactgtactgaaaaatacccttgatagttccatatgacaaacataatgatgaatttcacttagtctgtcttggcttagctcaatagcactaatgatcaagatactggctgataaatagagtcctatttggcctgggcagtcccagcataattatgtaatagtgtcccactatattctcaaaagcattccaatttggatgataaattatatagtcaccttggttataactccatgctggccagttagcttagttctgttccatttatatagattatgtgtgcttcactccaaaacctaatgagccatttgtaaaagtgatggcttttgcggtgcccagggagagaatttgtatgtttgtatccttcaacacacatttattacagttattaaaaggttttattgatgatagatggtaatgtcatgtaaaaatgacatattatttatttgtagactttcctattctcttgttggacatgtaattagaaactaatatgacttaaagaaaaacaaatacacaaaatttattcatccaattaatctcttaatccaggtgttttttttttctgagactatacccatacttcaataactttgttgttactgagaatattttgagtttccctttttgtcattgttgtcagagaatgtatcatatctttaaaaagacttgttggaggatgagtttgttttgaaaaggcctgaatttagttgatgcaaagtcacagataagatggttcattaagctgtattaatactgcttttgtctaatagatatcattaccaataagtcagactagtttttcttttggcacttataaatcacctttgaagacaactttttacaaggaaataaaacaaatgctttgagaaataccagtattattgaaagaaaagtatatattgctaatggatgcagcattctggcataatggtttgaaaactcatttgattgctttgtagaagaatgactctttcagatgacccagggcctgtgagcctgccagaacttgaaaattctttcttccctgaggtgcttcaacctgaattcaaagagcagcttttaatctattagagatcattttttgtcctctcatttatttttcatatttgcctttgatcttagctcttctctaatctttttctgtctcaaccttattaacaggtgtctgtgcagacacttttaagttttgttttttggctcagcctgtcagttaactgataatcatgctgaaaggagaagcaggacaaaacagagttcaatgctgacaatactccttttaatcttgtccagcccattagcagagcaggcatctctgtgggccttgagacgtagtcccgtaaaactcatcccgtttctacttgatttgctttctttgagaactcttgtttatttttatatggaggtttcctgccttggattaaaacataaacctcaatctgaagttcaatttcatcttaatttatgaacgactaagagagggaacatgaaaagtggaggttagtgaaattatctctaattctctgggttaagagatacatgaaaacagtctcttgagtaaccatttgcaggtaaatatggaagtaatggttatggttgtctctttaagtttttagtcacaagtagaaaaagaccaagttaatttttttctgtgtgtgctgaatttctatttgtagtaagtgtaagaatttaagcagaaattctgattcgtattttcagataaaaagaatatgtaatttccataggtccagaaatagggagagtttgccatctggtggttcttaacggcactctggatattattaagagttgcatttctatttaaaattatattttaaaaaacgtttggaagatacttttattgtagaaactatcctcttagggccattctttaaaaaaatcttattttatatatttctcattttgttgatagtgattagattctaagagcaacagaacaatgatcatcctctcctatcagaatcactgatgtttagatgatttctcattttcccaagttcaaggttccatgaaaaacatagcttgagtgggattttatgtctctgcgtttcactgttgatatatatgtcctcccaatataacattttacaaataaccaagcacaaaatttaatattttaccttgaatatttaaaatataataatatccaaaagctcttgtaatttgtactgatatcttatactagcgtgtctgtttcacattaagtttaatgtcttaggatataaaaaatcttttttatggttagtgatttatcttgtttttttttccatggaatttctggatagcgagataaatatttccatactattttatttgatatttccaaatttgcctctgaatcaacaattttcctattttaatttcattgtacttgttccttacaacctaaatagctttttattatattttgattttatttaaaaatgtacttctgaataatatatctgtttctgtaaaaactgttagcactgaatttgccaaccatttgacaaatacacaaataaaatagatttttacggcttgtcatttgtaatttcatagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggtttgtgtttttcgttccttattttcaaagctcagctgtagtaacttataaaagtgtttctgaatcttttatagaatttacattcaaagttgagagaatatccatacggttctttaataggccactgatttttttctttttggaagatcatcatgtgtgttcatgacaaatcatgtatcatgtcataagaaaacaaatttagaaatcacctaggagtaaagcagtggaaagagtccctgagtgggagttaaaatatttgggttctagaacttgtctttactattcaggagctgtggaaccctgaatagtcaaatgacattcataatgtcaaatgagtttagtgcatgtgaaagttatttttatattgcaaaggggaattattgttggcatggtctaactgggacgcttggagagtcaatggctccctgagatgatgcagcttctgagtggaagatctagctctcttgcatcaaatattgatctcaaagatgaaaattctcaaagcaacttcagtgctaattgtgtacttgatcatattaccttgctagaaatgtgtgagttgtttgatagtactagagtaagtgactgggaagctgcttttgatccctagattctgttgtataaaaaatagcttcccgtggtttatgatctgttccttttccccatcgttcttaaggtatgctgagatatgctgtgtttcttatctgtatttgaaaataaaacatgtctttgtagtgtgtattcagcaagcgaaacagaaaattatgaatttctacttatgtgtgaaatatgctctgtaatgcatgtcagtgtctcaaatatgcttaaatatgatcattttatgtagtttaaaaatactccattataatattggaactttagaccataggatgcacagcttctagtcccagctctgtcactagctatgctgaaatttcttcacctgcaaaatgaggaagttggactagattttttctaaagccccttgatatttgttctagattccatgtttcactgtttgatgactttttactacaggagtccttcttcattttcaagacccagcactgcagttaagtgacttgtactttgtggaacccaagtggctttgtaaaatcatggcacaggttggtgtcttttatttttgtggcacgggggttatggtcaaagcatagaacagatggcgcccagagcattgagcattttagaatttgggtttagttaaggcagaaacttttgtgaatttggaaaactgtggaacatttcacatagaagactacttgaagagcttcatggaagaaggaaagatgtcttgagttcacttccatgacttggttttcaagccacatacagatgtttgtatcactctgccccatgctgctttactagatcctgatgatgtcattggtttggttactgaattagtcaattgaatgatggctttgtggaaatccttggggtaaacacatataagaaaattaggttgctgagcctgtgaaacctctatctagataacatggaggtgagttttgacttaagtgaaatgatctgagctttaaatgcttacgattttgaaaactttggatggccttggttatagctatttttttcttatatttcacatggaaaatgatttttttctccaaatgataatccattaccaatgagtttaattagttataataatccatctctgtagctttgacataaaagaccatttgagcaaaacatactacctcagggcttttcaaccccagcatgatgacattttgggccagataattctttgttgcacattgtaggatgttagcagcatttttggcctttatattcgagacgtaagtagtatcctctagctgtgacaagcaaaaatgtatccagacattgctaaatattgcttggagaatgtgaaaaattaccctagttgagaaacattaagctactgatttgttgatgagtaaaatttatagttttgcatgtggctgcccgagttcctaaaattattatatatttttatgttagaaatatctcttccaattaaaccataaaggtaattaaattcactcaggcagccttgaataattgttcctaaattccatctaaggaaaaaaaggaagctattgtgaagagagaactcagttgaggctaaatcctgtaccatggaactcaagagcatattgaaacattgcaatcagcaattatttgcagtgtgtcagttattactattttggtaggtatttttaaattagattttcagccttctgcacatatgtcatggataatgtgattttactcaattattaaatgataatggagacagtagtgtgacccagagcacttacttgagcatcagcttgacctacgtttcagtctctttaattacttattagctctgtgaaatttcttaatgcattaagcctttgtttacttactttttaaataaggaaaataacaattatcttctatattgcctccctggttcagtgtaagtgaggggtaaatgttagctaattttatattggatctatttggcaatttaaagaatgttaatcaggaaattttaaaaaattcagaactataaagaggtacttacgtagttttggaaagtgtgtcatgtatggggacaaataaaaaagatgtgtaggtagctgcatcctgtacagcaaaggaagttttaaatatatccagcaattttgttgtcctagctggcgcacaatagttatcaggaggtaactcaactccacatagtcaaggaaaagctaaagttgctctctaaagtggtgtgtttccatgtcactatggaacacttgaagttgcacacatgtgaacattaggatgggtatatcttatacagtagaataaggaagaggtttgcatcagaactccccttttaaaaaaatgcagattttcactatgactgcaataaaattcctgaagattctgtggagtaattaagttgaaactccatgaaagttcttctcattagcatagttataaatatgataatttaagtaaaaattaagttaatttgagccactcaaagttacttttaaagacagatttaaaatgtcaataaaatgataatttaaatttccgattaacctaaaaaagaagtgccatcatttttatttatgccaataaattgaaatataatgtcattttatcactaaggtttaaaggaaatgaaatctctaaataatcaagtgaaaccaagagcaacttgtctgacagctattagcaaaaataaataggagtattcaccttcatgaatcaaggcaagggccggaataatttcatggtgcagaagctctaatgagcccacccactctatgcgccccgagctgttaggtcactaaacttattaaaaaaaggtaccattaaggcagggagaagtttacaagactcatttaactgtatgataaaagagatatgaaagagacctattcaattaatcaggtggaacattaaaaagcttacatggcaatttaaccttgataaaaatacatgggagaaatacaaaggaatttggaaaattctctttccttgaataaggcatcagttagctattcaggttatgaggttgaaggaatgttaggagctcttttaaaggtgataaagtcaagataatgttgcagattttattcttatgtaacaaaccccctcgaaacttggaggcttaaaatgtgaacaatttatcatttctcgttcttctgtggcttgactgggctcagctgcgtggttctgctccacatggtattggcaagggttattcacttggcttcattcattaaactgagctggaaagtgcaagaaaggtacatgcatgtttttggagtattggtgcttctccatgtggcctatcatatggctaagttgggcttcctcgtggcacggtgatcacagaataattagacatctttcatggtggctggttaccaagagaaatgaagcagattttttctgtcctcttaaaggctaggccaaggactggcaaaaatattaattctgctacattctagtaaccagagcaaccacaaacctagctcagattaaaggggaaggaaaagagactctatatgaatagcacctatgtatagggatggaaatgatgtgtccatctttggaaacttccactataaatagtggtagcacgctatagatccactaggaaaatcaagcacaaactctttaaaaaataagtgtatcttagtaaaatagattagaataactagataataatggctaacatacatgaggttaatatgtgcttttcaaagattagctcatgtaattctcacagcaacctttccaaatggtactttattagcccctatgatacagatgaagaaattgattgacagagaggttgaataatttatccaacggtacacattcaggaagaggtagagttagaatttcaaaccaagtagtttgactccagggcctatgagtttatacattcatagggctgatattcaaatgagagaagagaagtaataaataaacatataatatgttgagtggtacagagtgctacaaagaaaatatgaagtgcagttggagatgaattgtcaaaaaaggtcttagcacttaaaaaacactaaaacagcaaacaattctctttaccacctaaactgtaagagcgatctggaattgctataaagtacacaacatgggagaagtcttaaacaacagtttttattatttataggcccattgcacactgtcattaaataccaatatgttcaatcaaccatgcattcattgattcaataaatactgtacatacaaaatagaaatacagaaatgggtaagacaagtccttgggcctaaggactttataacctggtatttcactcaactacatgatagcataaataatgtttgcttctgtttaagtattccttaaacattatagatctcccaaagaaaattaaatacaaacctctttttaaagtgaatttgacaaagcaaaataaattggaatatatagataaatatgctaaaatttgtcatatgtactttgcgtactttacatgtgttatttcattctcagggcaatctaagacagtcacttttattatctcattttatagagaagaaagctgtgcagtaaagaaatcaaatacctttcccaaggttacagagctagtagtagagcctggatttgaatctgggttctgactgatttttaactgccatgacaaggatcaaagctcaaagtgtgatctctgtgttagaaacatcggggttgctctttaaaaaagccgattctcaggcctcaacccagacctactgacccagacactgcaagtagaatccatcaaaatgcagtagttactttgagaatcatgaaactctgctacacagtctgtcttcctattcatggaagtcctctcctagtatataaatgtgaagtaatatttctatttcaaacctgtattgataactgtctggaagataattttcctgggaatatattattgatgagactgcaaaacagatgtgaggtattggattgatctttccattgtagctagggaaatactgatgttcattgtttcagtgaagttcaatgatttcctatccgaattaactcccttaatttaacaattttttttttttttttgagagtgaatgcccctctgggcttctaggccacatggttgctagagaaattaggtactgtgttgcacttgaaaacactaaaatctttctgactactttcactgagcaaagagacataaaatgctttaaatttgcaacatttcagaaaataaattttagtgattatttatgactcgaatctttcagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcaggtaaagaaaaccttaaaaaattaattgctacatggaaattcactatctattcttttaattgtcaaactaactgtagtctataatagatgtattaaataaataaatatattttgcttctagtgtaaacctcctactgacatgtatcatttattttggaataaaacattgcatctgacactttaacaatatagtaaatcacttactttatgtgtatagttactagttggcttatcactgttgaaattatttaagaaaggtaaatagtggagattaatgtgtgtgtgtgtctgtgtttgtgtatgtgtgtgttcttaaacaacactgagagagtttattaagcaagttctgagaagatagtgagttttcaacagaattttaaaagcatttatggcatcacaatggatgcctatgttttagcctatactatggaaatttttcctactgctctaagcaactgggaaatttataaagtaatatgatgttgaaatgtgcaaattacattgattgatggatgcagccaattttaaaaataaatatacactttttttctaggacatgtatttttcaggatttatataagattacatttgtctatgcataactaattgtaataatttatgtattagtgcacagggattaccgaaaatatttcatgcatctacatctgagcatgcatttgaattggttattgaccactgaatttttggtgtaggaaaaatatgtagtgaaacaatgttacaaaaagattacaattgtttggaatgattaccttcattgactttaagcagtaaaatcatttgctcaacaaggttgggtgttttgtgaggctgtataaccatagtgtccttttgcctttagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagaggtaagtatctaatgaagacttattagatttttagagactattaatttagacttattaatttttagagaaattagggagatggcatatgaaaagtaatatgccattttctcagagtttacttgtttggaaggcagctgaagaattagaaaataagctcataaaaccttggagtaggcaatctaaagacacacaagcacatataacctcatctaatttgtcaggaagaaaattccttaggtgctcactcagatcttgactgtgattacattgtagggactgtaattatctcttttctgttgcacagccactaagacatttacaaaaaaagagcaaatccggtgtttataatgctaactctttcttctaaaataaatagagacattttggtactccaaagggaaaatatcattttggggattaaaattagctttacacaggtgttactggtttccaaaataaaccttaccttgattggaattaatcaacatataggtagttacattgcattaaaaagttcagaaagttttgcgtttagcatgatcaaaaacttctttttaaaaattatgaggatttatttatgattttctttcttcatctgtcgagcatattaaactgcttaacagcatcaacctgaaatggatcttaatgtgcaggggatttaactctttttattgtaaagttgtggataaaatatttaatagatatggatgaggactcatatcagtaacaacccaatactttatttcaaaatgaatagatctgtattacaatcacttgtgttgtgtgcagtagattttttccctttaacttaggaagcagttaataattaatggctccattttttagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggtaaggaaatcaatttgaatgttttcaattgcaacactaaagaaatttaaacttaaaaaaaaaaaaaactttaccttaaagctttgcgacagtatgaggtttagacaaggtgttgagctctgttttgaatcatgtaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggtatgttttgatacaacttacaaatgcttttaagtgatccttcaatacttatgaagtgacttttaataaatgtaaatattcttatccataagggatgagttgaaaaatagtatattcaattatagggacagttcagaaaactgaattatatttattaccaataaaatcttgtattctagattcagaaaatgttgatttgagggtttgaatgctggcttattgagcaacataacctcatctgtgaaaccggaataccaaccacatctatctcatagaactgttataaagattcaaatagacaatacatggacctaatttaccaacatgtctgccatataataacagctgcagcttcatgaatgtggcaaaagcagagagtagataactttctagtcagatgtctggtagtctgcagcagttcagaattctacaagtgaacgtaggaataagtttttaaaattccaagtagatagatactaagtgaatctttaaaatgttctcaaatttcctagagaaatataggattggttagaaagggagggattagaaattatagaaaatattccattattttttcacatcaaaaccacaaatttatgtatctccttaaatgttgtttttatttaaaaaatgttttattacttctcaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtaattctttttgttaatttgagaataaaaattaggatgtaattttctccttataatttagaaaatagatttcataattatattgtcatagattttactgtcttcatatatttgttataatttttgtatttggaatgatatattttaaaggaatataatattacagatctggaatttgttttgcacataatcatgtagactaggatcaagatgaggatgagattatcatggaagcagaaatatttatgaaatatatctttgtatttgccttaattgccagggatatgggaggcaaataagacagttttcaggtgagttaagtgaagcagccatattttataaaatgacagaataggtaaaggaagcacacctcagtgtagccatagcaggggttttatgactcagtgtgacaatgctgaattctcatagaaatattcattaaaagccttgaaattaaagtcaaaagtgttacatggtgacatactcaaatacttttttttttttttttgatatgctgaacaatttacatttcttggttccgtgaattcaatcagtgattttcagtagagtatgatggaaatcattgaattcatgtagcatgtttaggtgctcattgagaaaaggtgaagtcatggtaaccatgtttcaatattctcatttgtatcttgacttcctgcacatggatttttgggcctaaaagatgtttttaaaacatgctcatacacttcagaagatgaaaagtgtatgcattataactactttgggaaagaaacagtcaacatatgttactgtatgtcattctgtagattacatgtgtggtttctcatgtctctcagaataaaagctaatgtctttacaagacctgcgatgctgtgatctgtctggctcctcggttatcatttttaaaaaaagatatactttgtacaaatttttttaattgacaagtaaaaattgtatatatttatggtgtacaacatgatgttttgatatatgtatatgttgtggaatggagaagtttagctatttaacatatacattatctcaaatatttatgtggtgagaactattaaaatctactctcatagcaatttacaagtatacagtatgttattattaactgtaggctgacatactcaagttttaaacattcctgagagtcattgggacaactatgaaatgcattagattgatttaatataaagcatttgaagacaattttgaccttactttgtttagtttttgttgttgttgtgtgtatacatttaattttaatcaaattaccccagaaataatgcctaagatctgtcagtcaggacataatattattagcaaaaagttgtccaaaatttgagacatgatatttaaagctaaataaactcctttatacccctcttattggcattgattgggaagtttaggttgaatttaaatgctttggaactcaggaagttaatgtattagtaatagtgggttaacataaaatgctgaattgtccttgctgaatcctacatcttaaccccagacttcaaggtatacaggaaagtaccagacatggtgcatccttcctctgaagaaatcccaaactgtcagacacagatccctaaaatatttctttttcctgcattaaaatgtgtttcagatgaatggacacgttttgagtagtgtatgtggaaacgtcatttacaaagtctgtttagttggccaggtgtagtagctcactcctgtaatcccagcactttgggaggccgaggtgggtgtatcacgaggtcaggagttgaagaccagcctgaccaagatggtgaaacctcatctctactaaaaatacaaaaaaattaactgggtgtggtggtgggcatctgtaatctcagctactcgggaggctgaggcagagaattgcttgaacctgggaggcggaggttgcagtgagccgaggttgtgccactgcactccagcctaggcgacagagcgtctcaaaacaaaacaaaacaaaaaacaaaaaagcaaagtctgtttagctacccatataggaaaatgtttgtgattactctcccttctctagacccatgtcccataaatccataaatcccatgttcatttacagaaagcagtctagataggagtttctcagtctttgagctgttgccattttggcttggataactaactctttcttatcgagggtcatcctgtgcactgcagaatgtttggcagcatctctgtctatccactagatgtcagtagtatctccccttccctcagatgtgacaatcaaaaatgtctccggatgttgccaaagataaggggtggggttgaataccagtgatttaaacaaattaggtgtatccttctaaaaacattttacaggtagcgactccagcatctttatattagagtaatctggagaaggttatgcctctctcaattttccctctttccatttttatttgtagggcagcaatgcattcaggcttttggtaactctttttcccaagatagcagtaactattatgcagtgagtaatacgacccaccttaatagatatgaatagacttgttttgtgaatatattttaaaatataaatgtatgggattctgttcatgcgtctgagaagccacagggtacatttcctctttgtggagctatttatttttctggagagccaagacaggtatttccacttcagtggtgtgatttgaggggttaggaaaatttccttgccttcaattttctttccaacctagatgtcacaaatacataatagtagtccttaactttatttttgttttcagtcacctgaaagacatgacaatccatactccatattaatgcagcggcgattctcaaatagagaagggctttaaaaaattagaaatctctgccgggcgcagtggctcatgcctgtaatctcaacactttgggaggccgagatgggcggatcatgaggtcaggagatcgagaccatcctggctaacacggtgaaaccccatctctactaaaaatacaaaaaattagccaggcgtggtggtgtgggcggctgtagtcccagctactcgggaggctgagtcaggaaaatggcatgaacctgggaggcggagcttgcagtgagccgagatcgcgccactgcactccagcccgggcgacagagcgagactctgtctcaaaaaaaaaaagaaaaaaaaaaagaaaaaaaaaacaactagaagtccctactccaacttgaaatttggatgtatctccctagagtatgtttcttctctatgctgcattgcaatttttctttgttgttgatagttgtccagattgaggggaggcagaacaagatgcatctatatgtttccatctctccgaccgattctctcccttccccctctacttgctttctttctcttttccctcttctgtttacccgattctatttctgattccagtatgtaacagttccctctgaagctctctcaataccaacaatcctaactaatggtttttaaaagtcaaatattaagtactggagggatagaatgagagaataccaagactgataagatgcaaataatacttttaacatatttacaatctaatagaaatacaagacatgctcaaataagttaattattttaatatactctctctgagcataaaatataattatatatgctcattatagacatataaaaaataaataggtagaggctttccatagatgtgtaatttcaccacttgaaaattactatatttccttatagactgttttgtgtgtattcacttatatccatcaagtgactacatttcaaggcactatatgagaaccataaatattgtacaaacaggatttgctaaatgtcggtggagagtaacagtccacggggctgatcatggtcagtttgtgaggcaggcctccaaactccttggggattgagatgatggagtagcagagctcttcaagggtatggaggcctgaaggtacaaagcatgctcaggaaattttggctattgcggtttgtctagagcacttgttctcaaccttacctgctcattactaattctactaagtacagaattaaaagaagaaaaaaatctaatgaccatttcctcctgggactaattagatcaaaatctttgaacccagacattagcgttttaaaaagctcctcagatgtactattcagccaggactggggcagggaaagctactgaactccagccttgagaatgagaagtagaacaagaggagaactttaaaaggatttaggggccactatatgactatggagctgaatttagatttgatttagtaggcaacgcggaataatttgtttctgaacaggagagtgacacaatcaaagtggaatgataggaaaattaattttgcaagagagagagaatgagttggaagtaaggaactcagaaggcctcctgggactcagcagaaagctctgaggccaccaaatgggtgtggtggtagtggaaatggagaagaagggaatgtaaatgaggctacacagtggactgccactgttagccgtggggttagaccacagcaagagttaaaataattcttcaattttaactccagaagggcctcaaaaagactttttgtcttgttatcatcagctatatggaaggtagaataaaaactagttaggagaaaaggtaataaatgtggcttttgataggctgtgattgagttggaagggcataccagtgaaatcaccaacacaaagttggaagtgtaggaaagcacttaggaggtggctataagtgaaaatgtgaaaattctctacattaaagggatagatgaagtcacagaagtggatgacataattgagcagggtatgtgtagagggaagacgggaaggttaaggacaaaatctttacatatatctttcttggagtagaaggaagaggaaatgttaaaggagatttgattcaatgaaacaagtaggtcaggtttctattcaaatttacaacagatataattacaacagatataatttatttagtttttttcgcttggacagcttaatttaagtgctttgtattttcttttcaaaaggtgatggcagttttggatcagtttaccgagcagcctatgaaggagaagaagtggctgtgaagatttttaataaacatacatcactcaggctgttaagacaagtaagaaattcaataatataattatattaaattgcacattattaatctactggaactcttattttgcatacagttgtgaaaatgcaaaataatgaccacatttctacttaagtttaattatgcaatcctagtttgtcttttcgttgtggagtagaaagttttgtgttatttctcctgttgagaaacaaaacactgtatctgagaatccttataatcgtgatacatagtgtgttgtaaaactttttgtaagactcacttacactcctctttttactttagaaccttgctgttcaaaatgtgctccatggacaagcagccaggcattacctaggagattgttagaaatgtagaaacttgggacttttcagtgccatattattgttcctgatactccacagtagtcagactcctagctgcctccacctgcttccagaccttgaagcctagcaagctcctgacttcgccttctgttttcttcagagtatttatcttttacttttctggtctagggagagaatgatttttatttttattgaacatgacttctgtgtgttcagggtgaaagaagaagtttaatgcatgatctcacattgctaatttgattgaaggttagaaatcttaaactaaaactctcactgataagcttgcacctctcttttctggatttatccactttaataagaactgctattgattacttgctacaaagatggagaaagttagcatgcttatcctatttcctactccctgtccctgtccacttcctaaaacttaaaattggttgcattaattttcctgatatagtaacaattataacttggaatgattttcaaaacttttgtttttttagtataccaactctagacagcatggactgactccttgctatgtgagatgaggaaaattaacgctattctttctccttttcccatcaccttctcaagttctttaatttattctattatttttatgtagtgaaagtttataacatttatattctggtctgtactcataattaaattgttcacattttgtctatagtttggttctgagaacaaaaccaataaatgccatttatatatttttttatttgtacagaaccaaaatatttctacttctagataaagaaatgcaaccttctgtcactaacttcttttactaatagaatagtaacattccaaatatcaaagtcaaatggattctctattgttatgtatttatcatcaatttataaaaataaaggcatattttaatttggtcacatttttaccctgatttaaaaaaaaatttgtttttagagatggagtctcattaggttgaccaggctggtctggaactcctggcctcaagtgatcctctcaccttaaccttctgagtaccagtggtgatttattttatgtagctttttgaggttttctgattatatacatatatttttaaaaaacgtacttcaggaaaagatatatattttcatcatgacttcaagtgtttctaagttcttaatcatacagtttgtataacagaatctactttcttcttgaagacattcctcattcagcacatgacttactgctctaaacaggagagatggatttctaggctgcttgtgcagtgattaatctatgagttagtttcctcgccctctttgattactctcaatatttcttggattccatccattctcttggttggattgtccttagtttttgttgaagaatatcttcgagtaatttttttaagaaaaggtgtttgtgaggtaaatgttttcagtccttacatgttaaaaatatcttagttttgccctcccatgtggtggatatgtcatcacactttattttttaggaatctaggcttgaaacaattttcttcaaaatttgaagaaaattccattgatttttagtgcccactgttgctaatgaaaagtctgcagtcagtcagatgtttgctcctatctaggatacctttaatttcattttgaaaactgaaaatttgaccttttgaatttcatttgttttcagtgttctgaacctttacaagtatgtgtttgtgtgtaggttgtttttcattccatctaattcattattttgtgaaaaattgtcttctgtgtattctcttctattatttattatttcctccctaacatttattaatcatttttattgacaactactatgtaccaggttaggtgatgggacatatgatatatatatagtagtaagctaaacccagtcaaggctctgcttctctggagcctatatctagttacttatgattcattattgcttatcattgctccaagagtatatgttagatgacaagccttttgggtctatcatccatgtttgagttccctcttcaagttttatctataatttgtgttacttacttgactgtctcttacaggtttctaatattttttagaattgcatcatctattatttagctttctggtgaattttgttttgataatcatattttccatttccagcaattctttccatcccctctggttgttcctttgtagccatgtttttggataaaatgtccataggtgtttctgttcatgtcaattagaatttttttttgtattacttgcattattgcttttttctctgaggttatttgctctgtgggttcatcttgatctttctcttttatcttgtcagttttccaaattgagtagttttgggtgacttcgtatgaagtaagtactctattgattgttaaagaaggactgtattgattattaaaggtaactagaatgggcattcttcacattcatgtaggtttgcttgttcaagttaccactttctgaacaagaaggttagaccatagacttttaagggctgcatactgcaaagggatactctgttctttaggttacatgggcagggatcactgctgagaccatacctgccaaaggaaggcaggctttgctctctagatgctggacttgaaattgtttcccctctgcttagtgctgcattattttttttgcttcttaatctgctgcagagtatctagatcagggtgtccaatcttttggcttccctgggccgtattggaagaagaattgccttgggccatatataaaatacactaacactaatgatagctgatgagcttaaaaaaattacaaaaaaaaaatctcataatgttttaagaaagtttatgaatttgggttgggccacattcaaagccatcctgggccacatgcgacctgtgggccacaagttggacaagcttgttctagatacttcagactctgttctacatctcttcatagatcaataacttgcagcaatgagtttatcagataaattatgttcacttttcatccataaaaaaagtcatgggaggtactcaccataggattggtttaatccagtcactctggccaattttctttaaaattcctttaaccttggtatattggtttaattccttcagaatggcttttcccattgtgataaactggttccaggcttcacgagtacttattccaagtacagaaggaaagagggtacctcttttgagtacttgtatttcaaaggaatcaaatggcctacataataacccattaaataaatagatgtctctcagccccagtgagtcatctgtgcttttctcaacaagcactatgttcagggcaatgctttgtgctaattggctttaggcctttgttaccaaactgatcactgtggccctgagggtgctgttacttagaatattcccaccttttctgagaggctgatgttggggtcacttccccctgaactaaagtccaggggctgcatgggtgagggttgagtaactcagtactctaaggaggaaaggaaggggaatatacactgttagttaacagtggttattcctgtattctctcttgtttggattctactggggatttctttctttttttgagtctttattgacattaggaatgagagatagaaacagggtgagagaggaagtaaaattaaatgtgaattcttccatcttataccagaactcaactgtatttttggaatctatatatccttacttttcccttgatttattacaaaaaattcttagtggctacactaagtaaattttgtaacctttaaaaaatacatagttataatattttaagtactctgagtaatagaagatttcatgtgagtacaaaatatcctgggggcattttaattattagtaacaacagtcacactgtagttctagaaccaaattgaacattttatatatagaagcttatctgtgaatcaaatctgacataatctcttttaatgtgtaggtaatttcttatataaattgattttttggccttgctgtcagcatgcatttcaaattttacaccatgtgtttggggagctatggtggaaattagtacattaaaaatgtctacagagccaattagtgtataagcagggaggcaaactaagggaatggtggaagaaattaaaaaaaaaggggtgtgcataatgtgcttcttctcttaaaaaaaaaaaaagaaaaagacaacaacaaaaagaaagaaaaatgacatttgacggtcattctaccagtagtcatggggcagatctatattatactgtactattacgctgttttttctttgcaattagtgagttgcttttccaggatagaaaatttggattagacctctgtctgtgcctatgaaaacaagcagagctaacttaactccttctcatcagttctaaccaactgacatgggcattaaaaaaaagattttatctactaagcaaatatgatcacagtctgaagctttgttcttggaaaatcccctctcagggtgttcagcctttcttcttcagcttgcagaattctccatgtttcagtttcctgataaatcagtgggcgccgctactccacatctttgaagctggttgttaagaagcagtgcttctgcagcaatcacagtttaaagcatgaatcaatttaacatcacacaagctatacatttcaacagagttacagtttcagagtaaagtgcaatatacagtataaagcgaatctggaattcaagcccaacaatgtcataaaagaggctgtgaagtctcacatgatgtgggccacagagagggttgttgccattggatcttagctcaaatactaccacatcttcggagtggcctgccatgggccacccttactaaggcaatccctctgtccaagccaaaatgatatctcggactttttttgaattgcagagagattgttgcagccagggattgccttagtaagggtggcccatggcgggcctctctgaggatgtggtaatatttgagataagatctgaatggcaagacttcagccatgtgaagggtggagggatttctagggaaaggggtcagcacaggcaaagaccctatgatgggaagaagctgggcacagcttgggattgaatgaatgccaatgtggctgaagggtggtgattgaagaggagggggagacgagaaggtctggaaggcctggggcatgatcagatcaggtgctgaggccgtggaagtagatgggattttcatctaagggaaatgggaagtcattagagagttttcaggaggggatgatatgtatttttttaaaattgagcattatcctcggtaaacttttgtagtcgttaaaccagagattataagcaggttttacctcatatgccagttgcagctgattagtagtggctatagagaatcctgggctgagaaggatactgtggctaaccagaattcagtagatgagtttgacgtggcctgttagtatgactacactgtgtgcactgtttctgcattaaatgtctgataaaaacagagccaaaggaaaaatagaacttaaaaatttaattctgacagtacagttgacccttgaaaaacataaaggttggggtgctgaccccttgtgcagtcacaaatttgcatataacttttgacctccccaaaaaactgaaccactgatagcccactgttgactggaagctttactgataacataaacacttgattaacacatgttttatatgttatctgtattatatactccattcttaccataaagcaagctagagaaaagagtattttatttaaaaaatcataatgaagagaaatatatttaatcttcgttaagtagaagtggatcattataaaggtcttcaccctcatcatcttcacattgagtgggctgaggagggggaggtagaggaaaggttggtcttgctgtctcaagagtggcagaggtggaagaaaatttatgtatatgtggactcatgcacttcaatcccatgttgtccataggtcaactgtagtttcaaaaccagctttttattactgaaaatacgggaaaaaaaactcagagaagaaatggaaagtttgctatgatccagtcatacagagaaatccatgttcagcctgttgatgcactttaaagaaggagatacgtgggtaaaacctgatgttgaattactcttacatgattttggacttttgcaggagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgaggtaagtaggtcatgttgttttctattcagtgcatgacaagtgtgatccagacttgctctcaggttctgagaacacttcccagtaacactgtgccccagtaacaatttataaacaatttggatgaaaactaccatttccctgatcaaattttgtaatttcagaaaataagagtatggaaaccatgcagaacctcatagcaagtagtaatagactttgaacccacaagttctgctctagaacccatcatcttaaccctgtactgatctgccttctataaaaatgtataagttaggcttcacagtatcaaagtaagtgtcaattacatgattccaatgaggaaagatgagtccatacttctcaaggggactagagtgattcatgttggattcttcggcatgaccatctcacatgtctcagaggcacacctaaccctgcatccagagcaagctttggagagggagcacactggagtggaaaggctgtggtctttgaagacaaaaggcctgggattcatcactattccacacatttagtaactgtgattttatatctctgattcccattttttaaatagtctgtgaaccatgactaatatttaatgcataaaattatgatgacttctgtaataattggagacattccagatgaaactcttgatgtcccctctgccattgctccccaaccccagtcaccctgttacacctgagagtcaccttacattcctttcttcctctctcatttcacagctaatccttcagcaaatcttttcagctctgccaccaaaatatatcttaatgcttctaacaatttctctcactaacgtctaaatctgagccagtatcatctctcattgcctactggtcccctgcttctacctctgtctcatgatagtcccattcctcacccagcctctggagtgatttttctaacatgaaagttggatcaggacttgttcctgttattacccctcccctgccttatttcttgggtacagtgctcagccactcccatccctgaggttccttgcagataccagaggctttatatctgctgttgatttcactcaggaatgtctgactcccagatgtgctctctacttattataaaggattatctgaatctttctgaatcctttcatttaggactctcagcagagaggatgtccgcaacgaccctttgtctctccagcccctataggactattgctgcctaggattctttatgttttcattttttaaaaacttatttattgtctgtcttgccatcagaatctaagtaccatgaaagaagggacttttcgtcttgtttgccattgtatctctagctcctaaaatagtaagccttcagaattactgtgttgacagtaggggaagggggagaaaggaggaaagaaggaaaacagtgcctggggcatagaagccaagcagtgtatgcaactttccttctcttctttctcttctgaaatgctatgaatatgccttttaggtagtatccagaaatgttccttcctgaaagggtccagaaactactgaaaactgtacagattatgaaatgaaacagggtgcagggatttggatttgagttgatgtttctgcttttgaacaccagggggaatcttgggttacattaatctaggtaaagtgcagaatagtctcctgtatttcagtgccctctttccttcatttaactaactctaggttctagtttttccctaattcttccacaaatccccaaagtgtttatttataaagtgaagaattgctattttttaacactgttcgaaacaccttatctctaaaatgacttattctagttctctgaaaccttactttaaataacaaatccagcagtttctgatgaagtaaatgaaatgtcagcatattttaaaataatttgcctaatttgttcttagcataatgccagaaaagctttctggattttgtatcacaaaaggctagtagatttcagtagctatcaatcttctaccagcactaagtatattttaaaaactcagcattaaggtttatttttccaagtatgtttcagcacaggaaataaaatcatgctcctttggagtcccttaaatgctggagctgtttagagtgacatacaagaactttcttcacgttacatgctctctcttcctccatcttgcttttaactgttagcttacttctccaattcaatccacttcgtttgaactctttatcataattctataaaacttatgaaaatacagtcaactgcattttctgtatgtttctgtgtttcaatatcttcaaaatggaatgtactgccttggtacatcacccactatgaatctgttatttctgttatatcccacagttgccaggccaggatacttgtcccatccaggccaaacaccttcccccgaaagcaagtatgcatttgtccaccaggtccttgactctattttacattatctttttagtcaattcatttatttttatgccactcctgctgtcttggttcagtatgtccagggaattatcagaatttcttttctaaaataaaaatctgtttatgcttgcaattccttgacagttctcaattatctgcaaagtgcatccaaacttcttggcatagcatcaaagatctttctgtatgcctcttgcttccctttgcggcccctgccaccccactgcccacactgcattctagccgtgatgacaggcttgaattttcagttatgctcatgtctgtccatcattgtatttgttattcctctctttccaccaagttgtctgcctagagagctcattttccttaagaatttcttcacaaaccatctctactatgaagctcaagtgtgtcatgaagtgttagcttctccaacttgtgtttcttgcagacactctgtgcaagacattgacttaggtgctaaagagggaaagctagatattatattgttcttgaggttgaaagcttacagtctagtaggagagtcaactttgctgtctttacctcagtgtttttctccctctgtgcttccctagcacgtggtacttacatatttctggaatcttgattaaacacctgtttgaggactgtctgagcacaatccttctggattgtgacaccctcaagggagcagagatacaaagatggctttgtatactaaatgactggccctcatagatacctagtacatatttgtcaaataaatgaatgcattctatttttggaataattctattcagaatcagataaagtttactttaagctatgaagaaagaagtctcttagcaactcttacaataatcacaatcaaagaatgactgtttaacttaatataaaccagtttgttttaataaaatatttgacaatagtcatggttacacaatgcataaattatggctaaattattatcaggaaggaaaaatctttacttattatttcaaaagctattttgctagtctattaaaagctattagaactgcacttcttaagattaaattctataattgaacattttaactaaccaagatattatctctttgccactgacattatttcaaattaagcttaactatttctttttagcctttggaaagtattctgaaagagtctgtgttctataaatatacttaaagaggcatgtcttataaaggatttggatactattcaatgatgtatgacttggctttagcttttttattcttaatctctcagcttttctcttcagcaggggaagagtacctaatggcctttcagtaatcccttggtaaatttttctttcaagcccattacttactgtgaaggtcaacttcattagtgtatttatcttatttttttcagcccaaaataggtatattgaaatgaatgggcctaatgtcaaatgtcccgactacatcctggaagagagagaatcttcagctgtattagttgatgcagttaaataatatgtactctccaggccctcatacaattgaaagttcagggtatcgttgctgctctgcttctaatccttccagaagtgattggtgctaggtgatggagtaactattaattgatataatgtgagccaaaaccaacagtcacgaataagcaaaggatttaaatttaactccattaagtcttgtgagaaattattttcaacataggttataacatacctgtgacatcacatgaaatgctgtagtcaatttgacatcatggggcagagaagacagagttggaaatcagaattttatagacatctaatgtgataataacattagtagctgagatgcggtaagctctttgaccatgtttccagaatggataagacctggttgagatgaaaactttacactgtttttttatattaactatcttttactctttgcctgaaatgtccaactctagttgctcgtgattgcgtgggtcagtctccagaaggttggactttaatattacccgtcatcttttccaagacaaaattgtattcattctaactcttagccccaaattttcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatgataaatagaatagagaaaaattttaaagctgagctaaacctctatgtggttttaggaaaatcaaaactattaaataaatggcaagtacaacaaaatcccatcaattcttatttaacatacttacattttgaaatagttaaaatattcatatgatcattgagagaattcagaattgcctttaagtaattgttcacatatacaaaagaaaagtctccaaaaattgggtctttgcctgagatagatttgtcttaaaattgaaatcattcacttatcagatttgacccttttttaaagcataactttgctgtgtaatattagacttatatgttttgatttccttctacaatatctcttaactttaagggacaaagtgagcacagaatttttgatgcttgacatagtggacatttatatttaaggaaattaggacaaaaattattataatgtaatcacatttgaataagatttcctgtgcattttctggcagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccaggtaggtgatcaggtctgtctcataattctatcttcaggatggataaccactgacctcagatgtgagttcagaagagtcaaaaggaaaacagagtctatcacattgtgaacagaggtttattttgtgaaaaaatgcaagcatcacattgtgatttttatcattgtattttgtaggaaaaaaacaattgatgtaatttttcagggcaaaaactgaataaaaagaagagaatgtttgatatcaagttatatgttttaaagttagatttgtagattctttagatactctagaggtcataaaaagtaacagcaaaaactttagtctaggtattgttggcacttgtgaggcaaatcaaattcaggtccacaaattctttttcataattctgaaacccaaagaactctgaaaatcccaagattttttaaaaaatgactaatttggtgtcaaaacctaagcaagctgacttgttgcttattacaatctttatttctcatgctcagtgtgaatatgcatacattttgctgcagaaatatatacatgtttgagtacagggggctggccgtgaccctactgagggtttctgtacacatcactgtctaccctgtggaatcttacctccctttcttagttcccaatcctgaaaagcagttatggggccagtgctctgtacagacatgttgtctcagacatcagtttgagcaggaagtaaatcatttaggggttggcatttgtttggagtgtggggaacactctatctttagggaaactttatatagttagttatttgtaagtaaaattacaggtggctatacatcatcttgctgattgcaactcaattaaatcaccgtgcctggcacagaagaaaatatgctacaggatatctcactagggaaaaggttctagttcgtttcctgcgcactcaacttttgtacttagataagcaaatggccccagattccaatgcctggttttatttttgctccaaatacatatatactcttttgttttggatagttacattttagaagtagactgtgtattctcataaacacttcaaagtgtatgttctggctgagagtgtctctgtgttgttcaataataataagactaattatcattttttgagtacctgctgtgcgtcaggcccagtgccacgtatattagagacaagatctcttatcctcatgccagggctggaagttagctattagtttctcatttgccaaatgagaaaactgaggctcagggagattatgtaacttgcagaatatcactcagtaattggccaagataagaattcagtctaaatgagaaccagatccagagatatttggctttaaattctatagtctctcctaaaccatatgcaactctaacatgaagaagcttatttaatcttcactattaaaaaagtcaaaacaaaacaacagagccatgaatagcaaatattgtcaatgagaggtttggaaaaacagtcttaaaggatgaaattccatagacctgatatatttccacctggaaaaagtgggcatgggacagtgattttctcttgaaagatctgctcatttttgtcatgggacatgaaggtggactggaccactcagtttcttctttctgcatctcccaacccagtctttctgttcatggggtgaaaatctgttgttgaagccttgtctgcttaattggacagtggatctctcgggtccctgtgggctgtgcgcttgtacttgagctctgcttcttcactctgtggtctaggccagctagcagccagctgagttcaccttggttcagactcatggcctttcattttcagtatctgacttcctggttttgctgaaaacctgtctaaaatgtaatatccatctgattcttcataccaagccacacaattcttcctgatcccttttaatctccaatattgaatggtggtaacataaatatggagacagatcatgtcagaaacccagggcctaatcttttcttttctgcctactcttctcacaggctgcttagtactttgtaagctttttttttttttctggctgtaacctagattttctctttatcattactctatttattattgttagagcacttctgattatctcagccctaaactctgcctccaattttaaataacaataactcccactcctgctaatactgctactactactaccatcaccaaactttttcttccccaaagcagttctgtttgggaaggaaacagttccctctcatacaatttcagttatcttcttgtcttttccgtttaatgaatcttcctgttaatgttacatcttttaacatggaaacttctagagaaacaaaagacgatggatttgttaaaccttttgggtgtatttttatactaactcttactgcagcgtgtgcattatgagtgtaggtccattacggctgtattaggagcagaaccttccagagcatgagcgatgtgctgggcttgtgcttagctctatccatgagttaagtatctcaatccttaggaccctctgacatatgtgctattattatttctagtctatagatacagagactaaagtttagagaatataaaaaaacatttacaaggtcctatgggacaaaaactgtaggacaaaatgcaaacccaagcagcctgagagcagagctcctggtccagcactgtgatagctggggacgcagagacagaaacaatgcaattattgacagggaccatggtgctgtgtctgtccacattttgaagataattatggtttggatattttcacctttaaataacttggagagtttcaacattaactcagtcagatggatacatttatatcatatcctgctgggagtgacagttaattctgggtcctatggcaattgcacttttgactgagatgaatgctgactgatggctttaacatttaactaatgcgatagtatttaacacacccatataaatactatagtcttcgggtaaataaaatgttaccggctggacatacatgaatatctgatggagattatggaacatactctactcatacttctctgaaagtaaaaaataaaagatatgtttcagtacacaatgtgatatgtactcagacttaattcataaatttctcttatccttcatccgtggatcttttctttatttacttattgcgtttgttaaaatgcaggcttctctgaaaaattatttttaaaaatagtttttagacaatgaatcatattttctcaagtattttaacattgtaatcattatgataattatccaaggggaaattatacttattttttattcatttattcattcatttggcaacaatacattgaacatttactaagcatcaaactggctctaccacttaatagtggcatgatgttcatcaagaaattgttagtgcaatcaagaacactagaaattcattggatgaatttaaagaagcttttagaagggtattatattataattgaggcactttatgaatatataaataatattatgttttcatgctagagatcatgccaatgaagatatttactttgaaaaggagaagattagaagtttaaaagcatttccatattgaagtaaatattcatttccatatcttcacagttatctttctctgagttctctgactcattgtgaaaaaaaatcccaaccttcttcacagctctaccatcttcggattgttgcctagaggggtaaaaactattgtaaaaggatgtgtgcactggatgagaatttagaattagacgaaatgacccctagagtcttttcctgctttaagagcctgtgattccaaattctaacagtacatttatcaagaaaaaatatgctgaacatttaaatagtttttgaatagtacctagatataatagatacctaataaatgtgctcaatgaataataaataactggttaagatttaaataagcctccaaaatctcttccacattctaagaagggaagcataaaggttgttaatgaactagtgactgtgtgggtagctcattatttttaagtactcttgactttgctgttcattatctgtgtggccttaggaaaatacacacatttctgaaaggattatgtcgtttgtaaaatagaaagtccttatctgtctaccacagatgattcttatgcaaatcaaatgaaatgttcaataaggtgtctgtaaaatagtagagagagatgaattaggagctattgtgatttgtttacattatgtcacaggtgcactttattagggatatgttttatcttaattacacaattctttaacttagattttgagaattatattatggttatataggaaaatgcccttattctaaggaaatgtataatatatttaggtctgaaacattgtatctgtaacaatatagtatgtaaattatgctaattcacatgataattatatgtaattatattaatatattactatgtatacaatatatttacatgcatatatgtggggaaatgttatcagttagtgtagtaggggttatcatactcaaattcgatgtctccatccttccaactcttcatgcttttccagcatggtgaggactgctgagctccatcttttgctggtagtctctctgtcaaatagaactgtttccaaattcagtcatttgctccttgaaggctatgaattcatacttcgttatatttttctggctgcatatttaaattactttaacaatcatataagttcattgtaaaaattttggaaataaaaaggaagataaaatgcacagataattttagcaaatgaaataataattatattgggatgtatttcttcctagattttaattatgtacattcccatcaactttttattttgaaaatgtttaagcctaaagaacagttgaaagagtagtacaggctgggtgcagtggctcctgcctgtaatcccaacactttgggaggccgaggtgggtggatcacttgaggtcaggagttcaagaccagcctgaccaacatggtgaaaccctgtcactactaaaaatacaaaaatcagctgggcacggtggtgggcacctgtaatcccagctactcgggaggctgaggcaggagaatcgcttgaacccaggaggcagaggttgcagtaagccaagatcacacccctgcactccagcctgggcaagagagtgagactccatctcaaaaaaaaaaaaaaaaaaaaaaagaaagaaagagtagtacaatatacattcatactcatatacccgacgcataaattcattgattatttactttttgccctacttgttctttcttgctctctttgcgtatgaatgaatcattgaaattaagttgtagacatcatgccatatcacctctgaacagtgtgtatatttctttagaataaggatgtttacttacataatcataataccattatcacagctaagaaaattaattcagttgattttttccacatatttgataactttctgtctatccacgattatgtcttacatattcttttaatttatgtcatagcatatcatcttagaaagtgatccctaagttactgcatggtatacattgtttaaccatttccctttgtgattggatgtctttaggttgattatatttttattattatcacaaatgttgaaatcactctttttttctgaagaatttaaaagtaatttatctgtcttatggaataaaatatttatttccccttaaaagaatttcaggcatgaacccaagagagaaggcttttttttttgttttagttgttgtttttatttttattttttattttttgggtagaaggagcagagagacaagttcaggaaataatgagagtgttagaattttgttcaggttaaagtgagttggagtgaagtttagaaatctcctttctactcatctctcctgtttttaaaacactgtcctggaaatagttaatattaggaacgagaaaaatggtataggttttcctagtacactttatttcttaattatgaaattctacttaataacttaccattgaatgtttatccttattatcattcaaggtaattttattgaagattgaagatatttataataaagattgaaggattttattgtcctgtgtggtcaaccttggggggtgagatgttatgagacaggacaattaattgacttgatcaaggtaccttgttataaaaataacacagcctggtttagaacatctcttcctgactctcttatttggcatatagcctaagtgtatgcctccttggatgtatgagccctgatgttggtcatatttattattttatctgcttactttcagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctggtaagttctgttttctctacaatgaagattttttttcttaatatcagcagcttcatttttatttaattgtagttgtatgcttaattccttaaacagatgatcattttttttgtttagtgcataaatattcttaaatcttgtgatatattaataaaaatcacctgaaaaaggtagcagttttaggctttttaaaaaatccgcaattaatattggtgtagttaatattatatttagaaacatagagaaggaaattgctgttagaactccacatttggtgatttttaattttcataaagaattactgtgtactcattatcctggaatgttttcgttttcttggagtgaaataatttacatgcaggaatggaagactgaatgatctataataataatttttcataagaatcggtaaatgtgtatttaatgttatcaaagctcatttggaatggttgtctcatgctttcaagaaattagaggactttgtaattcattccttaaccattactttagttctcaccacaaaataacattttaagtttatttagctctttctcatattttctgctttccctttcatttaaaaaatacttttgagtgtacacaatgtgccatgtacaggaaatagagctttatcttttttgggtataacttcaagatcatggcaaaagaaaacttattattaattggataaaccttagatataatctaggttatttcccttattttactagttttctagtgaaaatattcaggtctctgctgggtacagtggcttacgcctgtaatcccagcactttgggaggcccaggcaggcagatcacttgaggccaggagctggagaccagcctggccaacatggtgaaaccctgtctctactaaaaatacaaaaagtagctgggcatggtggcatgtgcgtgtagtcccagctaccaaggaggctgaggcacgagaatagcttgaacctgggaggttgcagtgagccgagattgcgccactgcactccagcctaagcaacaaagtgagactccatcttaaaaaaaaaaattcagttctgtgttctgcatcaaccagaataagctacgcctcttataaaaaacaaatgtgcacaaaccatctgtgaggacataaggattaaatgcttgcttactttgagtattaaaataaaaagtagaagctttattatatgagtaaaagtgtttccaaagtctatttgaaatgcaggtacagaatgaaaatctgttattttattaaatcgttatttgggtctctttttattccataaaaaaaaaatcttttccacatctcttagtggagatcaagttaacaaaattagctttaattttgtgacaagtaaatttacataaatataggattatggagataatatttttctttgcaatgtctggaccttttataaacattgagaggaaatataaccattcttacttatttagtatgctagcatgatgttttttaatgttttagatccagttaaagaatatggttgtgccccatggcctatggttgagaaattaattaaacagtgtttgaaagaaaatcctcaagaaaggcctacttctgcccaggtattcttaaagttttgttaatattttgtacagaacatcatttgcatatatgcatatatatataatcttcaaatatatatacttaaacacataaacacacagagacagaattaaaaatagttataaggcaaacctcctataattttcaccatcccaggcacaaaaaaaggacattgccaaaacctcacatgctcccatatgcctgtctcctcttctcttctttgaaatgcctgcccattattttgcccatttttctgttgactcttttgcctacaaatcaaatcagaaaaaaatttttatatataacatactaatcctttcttggttttatatgttgcaatttctttttcgagctggtggcttgctttttaaatttcttgtagggtgcccgttaatgaatggaatttcttaattttaatatatataaatttaacaattcttctttttccttcttttcctggttattcctatttggtcctgttgtagagcccatctttcttttagagctacaaaaatatttacctgcaatttcttcaaacattttaaaagtttgcttttgacaagattttaatccattggaattgacatttttatctgtatcccattcctttttttaatgtggaagactaattttttcaggttgatttactaaatggcttctccccttttgtcccatagatctgatgtgtccattttgtaatttattaaagataatgtgcatatccacgtgtacactgtcttccactgatcaactcatttatttttcctccagtattaccctgtcttaattcctgtagctttataatgatctcctctccctatttatttttctcatccaggaatattttaaccagtcttaggcttagcttttctatataaaatttagaatcatgctgtcaaatcttatgaaaaaccacattgtcgtttggattggtcttggattgaatatgttgacaatctggagatgatatccttatgatattaagtctttgtattctttttcttatttatttatttatttagaggcagggtctcactctgtcacccaggctggagtgctggagtgcagtggcaggatcacagctcaatgcagctttgacctcctgggctcaagtgatcctgtcgcctcagtctccatcagccaattgtgtgccaccagacctggttaacttttcctttaatttttttgtagagaaagggtctcactctgttgcccaggctggtcttgaactcctggcctcaagcaatcctcccgcctaggcctcccaaagtgcatgagcaactgcacctggccaagtcttcctattctggaatggcatgaattctctctgtttacttaggtcttctcaagcgtctttcaataaagttttgtaatgctacatacaggtcttgcatatcttttgctggattttcttgctgcaaattgctttaaatgcagttcatggcttgagatttgttttttaactgcccagttaacgtaaatctggtctatgaattgtattgacaacaagcttgtgagtagcaatttttcagcaaccttttgctccctctccccgctccctgcacagtcccagaacaactttccttatataccaatgaaggtggaaatgtggacaggttgatttctccttcttgtttatgctgaatatgcagtcctttggggtcccagctttataggtacagtccctttactaagactgtctatcttgggaaggccctagactccaacttctctcccatgggccccacaaagcatccaagagtatacatttatattatctcactttgtcttggcagacaaatgtcttcagggcaagtctggctttaggggtccactgacctctctggtttctgtctctcactgtgatttcggcctgataattccttatggtgtcagatcttcaatgtttttaatacattgtttttaaaaaaatcatttagcattttaaattgtttttagttggaagatttgcccaagtaaccttgtccaccatattatctgaaagagaactcttgtcatgttttacactgatacacattttaataaatgtgggttatctttatgttgtgagctcttgatttggtattataattaattggaaaagttttaactttaagtattctgatcaaaatagtcaagtacaactataatgactttatcaaatattacataatttttcttctacttggtttacttgttttttaatttaggttaccatcaatgttagtcacatgaacttttatatttatgtccacagtaaaaatttttcatagcttgttgtttttctttcttgttttttcattttcaattatacttcacctatacttaacagaatacttaacaaatatgtatatatatgacaatattaaaaagcttagacatacttattttatgtttaaaatataacatatactaggcaagacaggaaaactcatcacttttatgaaatgaggcacagacagagtaatgggctttcttggtgtctcctgagtggcgggcaggtggccatgtcacagctctaatcccagtttcctgacttctggttctgttttcttacggtgccttcacactgtctctccagatcaaaaacagaatctagagatgacttctaaattttgttaccaaagactgaaattcctgttcctttcaactactagaagctcaactaaattgttggcccaagggtttttctctcactggcggtggctctgcaatatagaattgcatgcagagtacctcctgactccgctaaaatcctgtttaattgacccttgagattttcttttcaagttaaaaaaaatactacacataccaaagagtatcaagcacagtttaaaaatacatatttgtcttttcatgtaattttatttgtagtttagattactaatcttggtgatctagttgggttccagtttaacagttttaggttttgcttgacagagctataacacttcagtctatatttgatttttcaagggaaatgagttaactcgataagtactgttttgttatctttaaactttctcaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggtaaatccaaatgctctttaaatctttcataatttaaagcatataccatttggaaagttacttaggaataaattaaataagagccaatgtaggattattattcaattagccttctgttagaacaagagtattcaagagcaaatgtgttttgctttagaatcacagcatatgtcttagctcagggtccctagaaacagagcctgagatgggttatcttgcacaagtgatttaaggaaagagaatcttagagagaagtagaggaagccagaaagggcagaggaaaaagctcagcagaaatgtggtttctgaagaggtccagcctcagtctctgcccacaaggagctctggaatatgaataggagcacagaattttcccactgccaggcaagggagccagtctttcattctcacatattgttcagtcattggctgcaatctgctgggaggtgggggtagtgtaactttcaaggcatttctgggcaagctgcctcctgtcatctgagggtattctgtgataaatagcacatctctgaactatagtagccaacactcagggtagctggggatggcgtacctgatggataaaggagatctggacatggctcctaaaagtggatcaatacattgtgttggcaaatataagataagtttctagacttcaaagacaacctagtattttgactgctgcctgaagataaatattgtgcctcaacattagttctgaggttaaacaatcttttttttttaattgatcattcttgggtgtttctcgcagagggggatttggcagggtcataggacaataatggagggaaggtcagcagataaacaagtgaacaaaggtctctggttttcctaggcagaggaccctgcggccttccgtagtgtttgtgtccctgggtacttgagattagggagtagtgatgactcttaacgagcatgctgccttcaagcatctgtttaacaaagcacatcttgcaccgcccttaatccatttaaccctgagtggacacagcacatgtttcagagagcaccgggttgggggcaaggtcatagatcaacagcatcccaaggcagaagaatttttcttagtacagaacaaaatggagtctcctatgtctacttctttctacacagacacagcaacaatctgatttctgtatcttttccccacatttcccccttttctactcgacaaaaccgccaacgtcatcatggcctgttctcaatgagctgctgggtacacctcccagacggggtggcagccgggcagaggggctcctcacttcccagaaggggcggccgggcagaggcgccccccacctcccagacggggcggcggccgggcgggggctgccccccacctcccggatggggtggctgcccagcggagacgctcctcacttcccagacggggcggctgctgggcggaggggctcctcacttctccgacggggcggctgctgggcggaggggctcctcacttctcagacggggcagctgccaggcaaaggggctcctcacttctcagacggggcggctgccgggcagagggactcctcacttctcagacagggcggccaggcagagatgctcctcacctcccagacagggttgcggccgggcataggctctcctcacatcccagacggggcggcagggcagaggcgctccccacatctcagacaatgggcggccgggcagagccgctcatcacttcctagacgggatggcggccgggaagaggcgctcctcatttcccagactgggcagccgggcagagggggctcctcacatcccagacgatgggcggccaggcagagacgctcctcacttcccagacggggtggcggccgggcagaggctgcaatctcggcactttgggaggccaaggcaggcggctgggaggtggaggttgtaggtagccaagatcacgccactgcactccagcctgggcaactttgagcactgagtgaacgagactccgtctgcaatcccggcacctcgggaggccgaggctggcagatcactcgcggttaggagctggagaccagcccggccaacacagcgaaaccccgtctccaccaaaaaaatatgaaaaccagtcaggcgtggcggcgcacgcctgcaatggcaggcactctgcaggctgaggcaggagaatcaggcagggaggttgcagtgagccgagatggcagcagtacagcccagcttcggctcggcatcagagggagacggtggaaagagagggagagggagaccatggggagagggagacggagagggagagggagaggaacaatcttcttatatggtttgaaggaatgagaattcacactgaaaaataatttttaattttagtttcagatgtcatcttgataggcaaaacttgtctgccaattaactcatttattgctgaaaattaaataaaattggcattgtttttaaaagtaatgcaagaaagcaaaaagagttatgttgataacagaatcctttattctgtacaagttctagttgcttaagcttaaatcaaatcctgctaagtatattttcttttcttaacaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaaggtatggtagtgaatttgatcaatggggaaattacagatcttttaaacgactgaattgtgtgcataattgttattgcatcagcaaagattgttcatttttagcctattttcattggtttgcatatattaaagggaattgtggaaggtcacagagatatttgttgtttttctgaatacagatctagctgagacatttataaaataagtcaaccatttattcaggcctaccagccctgctcctggtattacctcaactgtggctctatctctttacttctcctcagatcaatgaatctttgtagggcctcttcaaggataaattctcattcattcattctttgaaaaaaaaaaaatatatatatatatatatatgaaacccattgtgtgccaggcttaaacataccagttatctaactaccaaattaagaaaaaaattaaataaatgaattaataaattcttaataggtgaaaatgacttagctcttatcaattgcagggttcttgtcccaaagaaatatatctacatagcaaaatttcaggtgtgagttgtaggttggtgactgtaatatttggggcaggatgatttccaggaggcattaagattataccctatatatttctctggtttaagttagtattggaaaaaaagtactagaaaaatgtgaagcctgttttttgtacctgaaatatcaactccactggcagtttcggagttgaaattatttgaatatggtcaaagaaaaatttcaatggatggaattgggcaaggacgactttattcaagcctatcacagcaggggagagagatcagactgaactaaactccactgaaacaaaaggtgggagagttttaagcgcaggggtgagctaatggaaacgtactggagcaccttgttggaaggaagtgggagcagttgtcaatgtgattaggccatctgtgtttgctaattgtcccttattgaaggtaggctcctactctcccacagacactggggaattccttccttccttccatccctccctccctccctccctcccttccttccttccttcttcttttttttttttttgaaggagttttgctcttgttgcccaagctggagtgcaatggcatgatcttggctcactgcaacttccacctcctaagttcaagcgattctctagcctcagcctcctgagtagctgggattacaggcgtgcaccaccaaacctggctaattttttacatttttagtagaaacgggatttcaccatgttagccagactgatctcaatctcctgacctcaggtgatctgcccaccgcagcctcccaaagtgctgggattacaagtgtgagccaccacgccaggcctctgtcttgataattacatttcaaaggaatggctcccaggtccttggaaaagacattcttggggtataaaactgggaagagtctgggaaaaggggcagagaaagaatttataattccaagtcttctaaagtaaatactctaagaaaagggaggttaggaatttatagttgagaagtctatctaaagtttaataaagtggaggagaacattaaggccattttagtcaacatacatgttctttttgtaacaatttcaacatttttccttttagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgaggcagataattccttataaatatattgtggaaaaaaaacaaaaatatacttaagttttaaatatggcttgccattaactttttcttaagcattgaagaaatcatttaattttcttttcttcagattcctatttagtcattaaagcattcatttctctatccatctattcatctttggttccatctattcactcaacttcctacccgttcattctcctattgccaaaaagcttattatctgatgagagacagggaagtagagtataacccttaggttatttcttttgtaatttttacatgggaaaaagaatagattgaatgtaacaataatatttcgaatatgacctaaatttttttatgtataatatttgtacatatttatggggtacatgtgatatgttgttacatgcatagaatgtgtaatgatcaagtcagggtatttaggatatccatcaccatgagcatttatttctctgtgctgagaacatttcaagtctcctagttattttgaaatgtttttaactgtagtcactttattgtactattgaacattagaacttattcctcctatctaactgtatgtttgtacccgttaaccagcctcccttcatcctccccttctcccacacacccatatcctcccaagcctctggtaactatcattctactctctacctccatgagatcaacttttttagctcccacatatgagtgagtacatgtgatatttgtctttctgtgcttggcttatttcacttaacataatgacctccagttccatccatgttgctgtatatgacatgatttcattcctttttatggtcaaatagtattccgttatgtaaatacacacattttctttatgcattcattcattcatgggtgcttaggttgattccacttttttttttagctattgtgaatagtgctgcgataaacatggggatataggaatccctttgatatactgattccctttcctttagattagtatcagtagtaacattgttggattgtatggtagttctatttttaatttttttgagaaatcaccattttgttttccgtagtggctatagcaatttacatacacaccaatagcatatgggcattcgtttttttccgcatccttgccagcatgttattttttgtcttttttataatagccattctaattgggtgaagaagatttcattgtggttttcatttgcatttttactgatgattagttaatgttgagcattttttttcatatatccattggccattactatgtcttcttttgcaaatgtctatttagatcctttgccaactttttgttttgttttaagacagggtcttgctttcttacccaggctggctcacagtggcatgatcatagcttgttgcagccttgaccttctgcactcaagtgatcctccaacatcagcttcacgagtagctgggactacaggcgtgtgctaccatacctggctgtttattttttgtagagatgcggctccactatgttgtccagactgatctcaaactcctgggctcaagcaatcctcctgcctcatcttctcaaagtgctgggattacaggcatgagccaccatacccagccctttgcctacttttaaatggagttcttttttttttttcctgttgaattgctttttcgagtttcttgtgtattctggatgaatagtttgcaaatatttcctcacatttaatggatcctctctatattgttgatagtttcctttgctgtgcagaagctttttagtttattatagtcccatttgtctaattttgtttttgttgcctgtgcttttgggatcttaaccataaactctttgtctagaccaatgttctgaaatgtttcccctgtttccttttaatagtttcatagcttctggtcttacatttaagtctttaatccatcttgagttgaattttgtaaatggtgagagagtggggcctactttcatccttctgcatactgatatccagcttttccagcacaatttattgaaggtggtattctttctcccatgtatgcttttggtgcctttgttgaaaattagttggctttaaatatgtgggtttatttctgggtcctctacattggtctacctacctgtgtttttgccaatactgtgctgttttggttactctagccttgtaatatattttcaagtcaggtagtgtgatgcctccagctttgttctttttgctcaggattgttttggctattttggctctttttcggttccactcaagttttagaaatttttttttctatttctgtgagaaatatcattggagctttcatgggaatttcattgaatctgtagattgctttgggtagtatggtcattttaacaatattaattcttccagtctgtgagcatgaatatctttccatttgtttgtgtcctcttcaatttctttcatgtttttcaggtttccttatagagatcgttcatcatctttgttaaatttactcctaggtattttattaattttttgtagctacttcaaatgggattgctttcttgatttttcagctactttgttgttgttgttgtatagatatgctactgatttctgtatgttgattttgaatcctttactatactcatttatcagaactaagagttttttttaatggaatctttaggtttttgagttttaattttaatatctctaatcatttaagatggaaagtagttttttgaaagcacagattttatggagttttgttctgtggatactcaatttgctgagtgtgttttcttttttttttggcaaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgtaagttattttttatctgtacaagtaatttatcattatacttttgttttttccttataatcattaataatactgttgataattcataaggaagatcttttaaaatgcataatttattttctatcataaaattaaactttcattataaaaaattttgaaaattccagaaagcagaagggtatttttaagaagtcactcaacctaatcacttttagggataaaatatgtaaactcattgtaatcttagtagtatttatcaatctaaattttttaacaatttttattatctgtgtttcaaattagacatgaaattggaagacaatcaactttgtatttcaccaaattcacggactatacatatgcaatttgggtaacttccattaagtattgattgtaggaaagatagacagcaagtattcttgcttgtccaaagttgtttctagatttgataattatacagatgtctactcacagccaagttagtgataccagtttcaaacaagaataaaataaaatattaatataaacctctttcaagtttgctttttttcagtggtattttaatcaaatctttgcagttggttcttatttatcacattcctcagtgataagcagtataggattgtggataagagcataaatcatagttcagatattgctttgccatctattggttttgtgaacttgggcaataacctttcacatcttcagtcatctcttacctgaggattgtaatattctctatctcaaagagatatttggaggagtaaataagaatgttaatatatggatcttaattaacataatgaccagcacctggtaagctgtcaataaacattagctattattattattattagctttgagtcacaaatccctaccttagggaatatcctggtttcccattatccatcaaatttcccaagattggcacttgggagtaatctttgactcctttgttttttgctccctttatccacttgaccctcctaattgtcatttgaatctttgtacttctcactgttctcagtgctggtaccatgggccagactgccatccattatctgtggccacattaacaagagcatccagttctcaccctctgattatactctcttcaacatattttcagcattgcagacagagggacctttctaaaatgtacatcaatctgatgcaattttcctgcttaaaacccttcagtggtatcccattgtcctttatatgaagtccaaattccttaagacagcctactgggcccttcataattcagtgcttgcttacctgtctagattcatattttgcaagctttttgccatctgtgctttacccaaactgaaattgactcagatctctaagacaacctgttattacctttcacccccaacctttgaatgtggtcttctccttacctggatgactattatgccccctgcctatttcagtccaagcaccacttgctctgagtggcaggttaggtgactttgtgcttccattgcatctaatgttttccttcacagtagctataattgtatttgttaaagtagtttctcaataccactaaatctactggctttcaacattggctgtgcatttagaaaccactaggtagctgaaaataatatgatacctgggccctacctcagaccaattaaatcagaccagttaagcctgggatggggatcagattttttttttcaggttctcaagtgattctaaagtatatttgaggttaagatatactgcggagtgcagtgtattataagttcccatgaatgaggatttttatttctgtctttacatatttatttactagtatgtggttaacatttggatcaactcattctcattctgtaatacccacattttaaaaaatgaatgtaaaaatgtcttttattatttttatttttcaaatttaattttagattccaggaatacatgtgcaggtttgttacaaaagtatagtgcgtgatgctgaggtttggaatacaactgaactcacaacccagaaagtgggcatagtgcttgataggtagtttttcatctttgctccccttcctgtaatttccacttttaacccaattatacaagcctgaaaacctttaaaaagaaagggcctccagtttatttttttatttcatagcacattttatgggattatggatatcagttaactctttaaagttccatataagatttggagcatagatgctttactagagagcatccataaagatcaagctctcaaagatgctcatctcccaaaagagattgggacctagatgcataaacacttaaatataaatatttgctctcttctgaacaagtatctcctgtggccttggtctctaccccacaaaacagacatcacatcactaatcaggggttgcctcatcatcagtaccctcatcatcatcagtacacaccgactgagaggcatgttgggtaatgaaagatgactgcctttgaagccggaagactccataggacttttggagttctaggtctgcaacatgtttttagtcctaggtcggcaagcatgatgttagtcataggaccttgagcaaattatttagcatttgtacatgtttctttctactattaaaaacattgagatttatcatattttatgtttttttattaaggatcaagcaagataacacacaaaagtattttataaaatacggaaattccatgcaaaactttgtcctaattggaactattttctattaaatacagcaaatatccaagaaggaattacctaaagcgtagtggctctctgacaacacatcatatttttacctccttttccagaatagaaagaaaagggggaggaaaaaaaatcttcctactctaggatatactaatgattgttaaatctttatggtattttcatgttatctatctgatttaaatgcaattttgactatttttacatattcctcgttgttcattcatactgtagtgccttcttctattcccccacttaacagactgcttgattatatcagaggtgcttatctgtgcaactgtttactggacgaggggtatgtagaaaatacattgtcctcatccttatgaaattacactcataatctagtgtgagggatgcactaataaagacaattttatatttaataaggtctataatatgacagtgacaccagtggggaaaagggactggttggtctattttgataggtcagggaagaaatccagaggagccgacatttaagttcatcctcaaaggccaagtaggagtttgccatgctgatgtggcccaaggtagccaatctgtttgtgaaatatgtacaatgccagatgtcttaggttgaaagggaaatattttaaggtgttcgtaatttttctttatgtttaaaaggggaaaatggcaaatattttactttctgtttatgtttggatgatgtggatttttgttttctataatttgactggcttaactgcaaagatatcccttgctttaaaatttgaagacactgcaactaaattttatttcagcattttatattttataactctaggtataaaaggctaacacttaattttctgagcattcatgaaacaaagttttgcaagaacattcaaaagttacagatataatatttccttcagaaatttagatatagtacaaaattctacaaagagccacatagaattgaaactaaaagtaagaccaaagtaaacattggacataatctttattttattatcacaagaaattaatataaagtaaccaaaagtaagtaaagtaccaaagcatgttatatattcaattcagaatggttagggaagaatatgaaataattgcaatagtctagcttgtttagttttcaaaatagtgtttttacattaagaactaatataaggttgtattacacgtagaaattttaagaagaaaacaaatagtgatgactttctatttttttttctctgtaggttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaaggtaaattctgtggtttttaattttattcccaaaagaattatctttgcacttcatgtgtcacagaggaaggatttttcttcctttctgcctctgaatagagaatttttttaaaatgcagaaaaaaatttgtaatgcttctcagcaccatcttttcagatcaagaaaattttgtcttcagaacataaaagaataggcacataatgtgcatagttttctcatggtattacaaagaatgttctcgaatgaaaatactacattattgaaaatgagcatattggagtctctgctagctttgacatagttctgtcacagtgtcaaatatactatttataattaaattatgggccccaggattatctgctctaaagaaaaagagtcacaaaataatagacaaatatggggggaaatgcaatggactgaccgaggcgctaaggagtggggatcaagaccccagaatgagagcatagtgcttagtctgatgcagcctgtgagtgacaaatccatagcaagcacattctttctgtgctggtgctgagaaacaggaccattttcaagcttatttgctagccactttatatttttattttgttttgattttaccatatagatctatgatactcttgagaacattttagattacacactatatctgtaaaaggatacttcaaagtttcctgtcttagattcatctgacagtttttctatggattgtgagaagggctcacagtttatgttcagaagggccaacaggtctccttgataaagggttccttacttcctgaagtaccaaaacgattaggattcttttatttctggacacttcatttttgtcatgaattagactattcactggttctgggaaaaaattcagtggtttgtatcgatatcttttacatgtgaatgactataattttatgttcctttgtaacattgagacttcatgtaaaacttttgactctaacttttttttttctttatcctgggcacatgtatgctatttttactgaattagatagctttggtatttataaaaattgtatccctcttattcataatttcctgaaaatgaagggctattgttatctttgataatttatgcttcaagtaaagaagtgtggctctttggcatctgtatttagcaaaatttgctttgtataattttaatgatgcataatggtggtggtgtcatgttttaataatttaaaatgttgtttatgttatcatatgtaaatagcatttatctcttaattggtggtaaaattattaatgtatactttatggttctagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggcaagtttctttcctttagatatttttcatattctctaagtcttataaaatatgcctttattttacgtttacattttctctgaactttccagtgtcatatggatggtcttggagggtcacacagtgaaacataagactggtataaattgtgaatagggtcattacagaagtggagggagtaaatgctctcagtcccacaagagaagcagattactgcagctgaacactcagtttgggtcttacttgcttttttcctttttacctaaggcaaaaatgggaaatacatggtattgaatatattttactttttgagcaaagaaaataaagaaaatgtttgttttaatcatagtctagcctcccagcttgttaaagaatctcatttggtttttcattctataacaaatcttttttcttgcagcaatacatgctgaactgcacaacctacaaatattgacaaatcatattttactcaaactttgtctttttttgcttctatttttatatttaaatatgataaaattgtgatagcacataaaatatattttctgcataaatatatttgcgtcttcctttgataataatttgttttagaaaataacaataatagcatatatacaaaagtttacaaaaacgacactatggggtttaattctgaaaaaaactagaatttatgtaactttagcaaataatgaatgttttgaacatggtgaagaaaatatattcattgcaagtatatgtgaaagaggaacatgtgtttttctagcaccttcacctatttttcatttatagactttagagttgcacaggagttacaattagatgctcttaatgactgtaaactattaagatacatgtccacacaagcagagcagtaggtctctcaataggttgtctcagtagtcttattctaccaaagttgttgcattctctagttgaattgtatgtactttgggacccaaatagcttgcttataactgaagttatagtggaatgtctatgggttatagtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtgtttcataaatttgtagaaaatattacatatggtataatcaggaattttaattggtagtttatagtgtaaagaacttagacataaattttcaaaattacaagtgatatgaagtgttaaatatttatattttcagctgaagtagaggtgtcaatcactagctcaaccttaaacgaaatgtgaatattttttacaacttatctatatctacataatgtctaattttgaacagtgtttgaaaaagcttttatttcttttagaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaa

SEQ ID NO: 2550 - DNA, 107093 bp, Homo sapiens
actccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttgggtgctaggggcactgggtcgagttcttagagaaacaggccttggtggccatagttcttccccgcgttccctctgtggaactctcggtgtccagagtttggggtgtagaagggcggatgaggagcgacgcgactctgaagagttgcagttgggctgtgagctgcaggatttccgccgtctctggtgctgtgggagccgatgggccgggggaggcgttcctgggaaggttaatggagtaattattgccccttctttctcccttcctacctatctagttagaattgggcctagaaccgggaaagactaaatgccaagtgggactgggggaaacgttgtttggtttacagaaactggcgtttggggattaggccccgccagggaggctgggcgcgccaactttgcatccctcagcctactccccaggaactcgcctggtttaattttttttgttttgttttgtttttttgagcgagttgaggtctgtattgtgtgtcttacgggtgacggttcgtgtttgggcgctggaaggagcgggctttctgggcgcccctaccacccccgccccataaccgctttccagactccgcctgctggtgttctctggttaccggagtgggtgttgcagagcctcgggtgcacctgctcctttctttccctagcaccttcctggtgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaaaccactaaggctgttaaaaatagctaaatgaaacttgaaagtaacagtttcaacttcgtttagtaaggcatagcatgagtagaagtgcgtgtttaaagtagaaggattttatttttatccccgttcagctacccgtagtactgtcatcaatcacttctaccaattgttttcctacagtttcaactttcttatcttactgtctttctgtttaacttgcatggcaaaatttcaaccttgggtggattcagtggagtgtttatattgagggatatgagcactgctggaaaaaaatatctgtagtatgtgttatatgagtgaatagtctctcgtttccctgagtccgtagtgctgcccacggtcattctccattccctacttttctacgctctctcagacactgctgtctcaccctcacatttaatgtacagtccttcctacttcacaacacttaggaacacctttggtttcctaccaccacatctgctaagcagcctccaacccattccatcctttcttggtttttttcaattaaagagatgttcttcttcctctctaaagctaatcatttgtcttttgctctagaccccaatggcccccgctttctcagagcccacatgctagttgcttatctcctttctcttctgcatttttagtatctccctcttttttttttttttttttttttttttttaaagtgaggcggagtttctctcttgttgcccaggctgagtgcaatggcactatctccgctcactgtaacctctgcctcccgggttcaaacgattctcctgcctcagcctctcttgtagctgggattacaggcatgtgccaccatacctggctaatttttgtatttttagtggaaacagggtttcgcagtttggaacaggctggtctcaaactcctgaccttagatgactcacccacctcagcctcccacagtgctggtattacaggcgtgagccaccgcacccgaccagtatctccctccttaccaacaaattgtaaacgtactcaagatacttctattttaataaaactttccttatgaccgtctgtgcttgcttctcatcataggctgattccttaaaaatattagctaatgactttctttattttttccctcttccttccaataatacattccagttatggaattgaccctcactacccctgctgaaatttctcaccaaagtcaacagtaaccttgttgctaaatctaggaggatacttctcagtacttctcttatctggcaaggtaactgtttggtttcttatcacattctacttgatacacttttccccttttggcaggctctcctggtttccctcctgtctttctgtaccttattagtgtattagcgtgtccttttcctctgcctctctatttaataccagtgtatttaagatctggtcttctcttactctttatcgtctccctgagtcctctgtcccactttttgagtggatgactctccagcccagatttctctgttgagagatagatcgctatttgtcaaccggacaattttattgggtgtattataggcacatcaaactctccatttctaaaacttgaactcatcatcatcctctctcaacaaagaaaacttgtttcttttctgatcagtttaactgtgtgtcacatacccagtttctagcaacctttatcctttatcttttaactctactatcctttaactcttctgcttctttatcgcccgtgttgtaatacagtagtctgccctattctgtgtgggataccttccagagacccccagtgcatgcctgaaactgtgggtagtaccaaactctatgtgtatgttatttcctgtatgtatgtaactgtgataaagtttaatttatagattaggctcagtaagagattaacaataactaataagacagaatagtcacaacagtatactgtaataaaagttacaagaatgtggtctctgtcgctcaaaataacgtactttactcaccagtttcctgaccatggttgactatggggaactataatcctgtaacacaaaactgcagataaggtggggactatagtcaccaactcctattgatcctgcacagcagttttgcttgaattggtattctgtacatccttagtcttttcgttattggaatacttccttttttttttttttttttttgagacagagtctcgctcttccgcccaggccggagtgcagtggtgttatctgggttcactacaagctccgcctcctgggttcacaccattctgcctcagcctcccgagtagctgggactacaggtgcccgccaccacgcctggctaattttttgtatttttagtagaggtgacagggtttcaccgtgttagccaggatggtctcgatctcctgacctcgtgatccgcctgccttggcctcccaaaatgctgggattacaggcgtgagccactgcgcctgaccgttactggaatactttctgtacttgtaagtactagtttatattaatgtgtttacagaataaaatttagaaggcagagattctgtatttgtaatggtgacatttaggtggttaaagaggttgacatgaagagaaataacatgccattactcttatgagggagatacttagtatttttgggaaatgttgtgaatgtggccgggtgcggtggctcacgcctgtaatcccagcactttgggaggccgaggcgggcggatcacgaggtcaggagatggagaccatcctggctaacatggtgaaaccctgtctctactaaagatacaacaaaaattagccaggcgtggtggcgggtgcctgtagtcccagctattggggaggctgaggcaggagaatgacgtgaacctgggaggcggagcttgtagtgagcccagatggcgccactgcactccagcctgggtgacagagcaagactctgtctccaaaaaaaaaaaagaattcatccatatgcaattatttctttagcttcatactaatagttttactttttaaaggcatactaatgctgtgccttttaaacacatttggtgtcatcattaagttacaaagtattctaccccctatggcaatcacagtgtaacagtggatgaaattgttcattttgccaacctgatagattagactttagtaaattttgttttaaaaaatactaaaaaaatcatctgtttttcccaaactaattagagtgtacagttttaaaattgttttagaaacttattttagtagtgttcaaagtcgttagccagaaataggtctttggaacaagctctgcattttagggggaatttattgtgatagggaaatagaatgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgccaaaatgctttccagaaatgttatactggtttatattctcaatgtagtgtctgagaattccattttccttttactgtcattaggattagataatatgtaatttatatgaaagttagcaaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatggaagatagtttttctacttattcacattttttctcccatattgttttatagagtttaatagtgcttcttgacatagagccaaattattactcctagttattttatatatttgtcactattataagtagcatcgtttaagtggtattggtgatattttgacgttctctagatttttaaaaaatacctactctttaagaataccaccttttctcttttcagtggtaatatttctgtttcatatttgtctgcttgatagaatttctgaaagaatgccaagtaactgatatgtagcattcttattttggtctttattggagatgtccttcatgtcttattttaagcataatgttgactgcttgtttatacttactttcaactctttagagaattattaaagtaatatatgctcattaaaaaaagagtgaaatataacaggaagggtcaatgtatttgtgatttttaagatttttaaaattaatacttcgttgaattttatcatttttattttgagataaaatttaatttgctatataatttgttaaagtaatatgttattctaatagatattctagcatcaaaacatctgtgggacaaattctactttttcagagttgataatccttttgatattttttctctagtgaatgggatgagttagggtcttagaattaaagcaacttggatttttatcattattactatttatttaatttttaatcttttttttttttgagatggttttttgctagtcacccaggctggagtgcagtggtgcagtctcggctcactgcaaccttggcttcctctgttgaagccatactcctgcctcagcctcccgagtagctgggattacaggcacctgccaccacacccggctaattttgtatttttagtagagatggggttttaccatgttggccaggctggtcttgaactcctgacctcaagtgatccgcttacctcagcttctcaaagtgctgggattacaggcgtgagccactgcacccagcctattaatatttttttattgccatttttagctgaatgaccttggccaaactgtctcttttgaatgtcagtgcttttgtgtgtagtttaatgacttttcatgtcccttgaattttagataaaattatctcaacctctcctctttcagctagcaccctttcaacctgtacaattccacagctagtggaaatccaaagtcttctgcaagattatgcagaaatcttactttctgatgatcatctctgcctttgaacctctacttccaccattgctgctgctttttctcatctctttgacccaggtaggaaattcagtccctttcttgattttcacatgtacaagcaaaaaccccatttttatggggaggattagagtttggtagtctttaccaagatttagagaaagcactaatacaaattaaactagggtagtaagcatcactattcttaaaatgtcttctagccactgcacttttggatgttttggccctagtcctgcttctctttccctaccttcttatcatcttgctattgtaccttcctgttaaaaccaaaattttcttcttgtttcttgcagagcagttctcccgtctttgactctttggcatacaactaatgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattgggtggaaggacagttcataaagaagggggttttgttaaaataaggaaaatatcccaagtggtttactatactagtactaaaagaattttccagttggataaagtgggaatttacagacctttttgttaatgaattaggttatgtgagtttaactaagtaaataaaaatgttttctatttgaaactataagcactttttgtaattccatattagctgttaccatgtacatttttacctataaaaataatagctgtctttattgcttactaaatgctaggtactaattagttttaatcctattttgaaggtgacactattttagagattaggaaactgagactataggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgataatgatgttggtaatgatcatgtatcatttatttatatctatttatcaattattgaacacttaactgtatatcaggcactgagctgaatactttttcagacagttcttcatgtagacacaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggtgacagagtgagactgcgtctcaaaaaaaaaataatgaaataaaaataaataaatttagatggtagtttgtcagattttttggtttatatttttatttttggaaacccctttcatttgctttttttagaaaaattatccagttgacttggttgcctctttttttgctggttttttctgcagtgtttaattggttttttaattttccatgatttgcataatggcattccagatagagttaaagacaactatttgtagttccacataaaaagagtttgaataggccgggcacggtggctcacgcctgtaatcccagcactttgggaggccgaggcaggcggatcacgaggtcaggagatcgagaccagtctggccaacatagtgaaaccctgtctttactaaaaatacacgaaaaattagccaggtgtggtagtatgcacctgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactggataagtcacaactttatcttctctaggcttatagttcctcaaccttcacatgaagaaattgaagtacataattatctgaagctgtcaaaatacattaggatccattaataattactaggagaacctcagttgagtagaggaaaggaagattgagggttctctgaaattggactactacatatttacaactcagggtttgatgcctaagttatttttttaatctgtaaactaaaaatatagttggtgaaagtgactttttcaaaaaaagtttaaagaaaaatatgtgtttgaagaattaatatacacctagcatcctttttggatttctattccaggtgccatcttcctggtatgttattactcctacctagatatttttattttctcccttctgtatatttcatcataggctgtactcccatcttttggctcagtttttttgagcatcagtctgaaatgttgtttatatgaatgtgaaagttattaagtagtaatatttcactaattttgaaaattgagaattcatttttagattagtgagaaatctgaagataattgtgtttaatagcttagaattctttatgattaggttatcacagttttgtgactaataaggattaaagaactttttagaaagtacgcttttttctcatttgcatatttttttctcctaattataatttatgctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgatgtataatttagcttgtaatatattgtttccaggttgtatttaaatttgtctctgctttgcttttccattttcttgttggattacattttgaatagttttaagattaacacttaaaatttcatcattttttgtaagtgccacttatttaatccatccctctacttttagactagatgataacctcctagcattttcggggaatttggaagtagttacttccattttatgtcatcagactcagatgaatgagcataatttaagaggaaaataatgatgcctttgatgacgaatataaaattcgttattttcttagatgtctgataatatgatgtgattaaatgaaaatctttttacataagattatcaaataaaaaatgtatttttaaaatttcagtcctttgttagaaatagtaggtgtgcctactttctaggttttgttgttgtttttaaatattacttctagtcttttttttttccttttttcttttttctttgagacggggtctcgctctgtcacccaggctggagtgcaatggtgcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcatagccatgtgtgaattagatgaaagttgtgttgaatttcttagtattgagtctaattttgtacgtttatcatcaccttcaaacttattttagtttctcgttaaattgcaaaaaaagatgattagttattaaaagtcaacaaaactaagttatgttttctaatagtctatcccccactgtctgcttttagtaataatttctcttctttgagcgctttgtttttgcgagtgagttaggttctcactgaggctaccctgttgtgaatcagtttattctgctgtccaaacctagcccactggctcacctgtctaatccctgttatacctaatttaagtttgcattttcacaaggaacgttatgactttcaaataacctctttttttttttttttttttttttttttggagacagagttttgctctgttgcccaggctggagtgcaatggcatgttctcggctcactgcaacctctgcctcccaggttcaagtgattctcctgcctcagcctcctgagtagctgggattacaggtgcgcaccaccatgcctggctaatttttgtatttttagtagagtcggggtttcaccatattggtcaggctggtcttgaactcctgaccttgtgatctgcccgccttggcctcccaaagtgctgggattacaggcgtcagccaccgtgcctggtcaataacttactcttttgtagtaatgatatagctgtatagagtactgtatacagtaataattacaaagatttttgtccccatttctccattgtaaaatttaaagtaccattagcttttatatttaggaaacagataatttaggaaaagataattaaaatgctttaacataatgactagtactagtttggttaatgactaaccttttaaatatttttcgagtttggaatatcagatttaaaagctttcctttggtagttaatattaatctctaaacttgcataatctcctttgatcatcagagatttctaggttagtcagagctttaattcttatttctgttttatagagaaggaactctacagagtttgtggcttgcctagatttatatagaattttagcagaattacatttcttgaattgtaggtcaggggtcttgtttctttttctgaatatgaacttttgaaagtaagcagataatttctttttaaaaaatactattatgagtcagagaataggagtataatgcacatgagtttgaacttcatactatttcaaaaagaattttagcttagtaattttaaaacaaatttagtcttgtatttatgagattttgcaggggcatgctaatgaaaagccatggaaagctacaattacagtatttaatctagtatatgagacattatcttgggataattatgttacctcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactgatcttagacctgctccactgagtcactactattaattggaatgtaatagtaaccctccttgtatgttgggacaggaaaagatgaaccactttaccagagttttgtgagcatccctttatttttaagttaggtggtaacttctaataaaatgattgttggcagatagatcggattgttaactagtttcaagttacgtatgtgagctttttaaattctttttttaaatttatttttagcttctcagagattaaaaaaggtgtttgattatttacattaatcagtagttactaatttctttccagttgttgcagaaactgcaggtagcttatctggcgtcagtatcacatctgaactaaatgaagaattgaatgacttaattcagcgttttcataatcagcttcgtgattctcaggtaacctagatgttttagtatagttgagtttaaaaaatcacattaattagaacagtgattcagaaacttcagtgagcatacatatcacctggcatgattgttgagcagtgtaggtttctgattggtggggtcccccccaccttcaaaattacgattcatggatttggggtgggcttctccacgtctcagtccaatgctggtggcctggggactatactttaagaatcactaaattagaggagagtttactttgaaggaagtgattaatgaagtttttctttgtatgctactggatgacgtattcttttttcctctaaaagacttaatggtcacaacgattaagactttgctttaaatctgtgtccttcgactagatacatgggattctatacagccttggaattctcatttgaaggaatattttactaacaattttaagaaagttcttaatttgagagttagcaagtgttataatttgatgcactttgtaagtgatataaatgcagattttcaatatgggggccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacagtaaataagccattgctaatgaatacaaaattcaagtttaagaaggatcccacttaccttattttaaaaaaagtctacatttttaatgtatgtatacataggcattagaaaataaaaacatgtagagaatggtagatgcctgattccaggttggggttacctttggagtgggtaatgacattggaaagggtacaaacagagctttagttaaatctgtaatgttatatttttcttaaaataattgatgcaaatatgggaaaatcttaaaatttgactaagcataatgggagatattcattatatgatttcctaagccctagtggattcttgcaaagtttcataattaaaaaaaatttaaaaaaaggccaggtgcggtggcttatgcctgtaatcccagcactttgggaggccgaggcgggtggatcacttgaggtcaggtgtttgagaccagcctggccaacatggtgaaaccctgtctcaactaaaaatgcaaaaatgagccaggtgtggaggcatgcacctgtaatctcagctgcttgagaggctgaggcaggagaatcgcttgaacccaggaggcggaggtttcagtgagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaaccttctttgtctaaatcagatctagtcttcagttcctatcctaataccttttcaaacatggcccctgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagtaagaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggtagacattaaataggttaaagagatcttaattgccgaagtttatatgactgtccaatccagaattcagacttcctgataccagagcctgcgatcttaacctactgtatataaaagaaaaaccatatgttatcttattcagtaaggttaaagttagaactattaatcataaattttaaaaagcagtttatacatattttgtattatagttacacaattaactataatgtacaattgtatatttatacaaatgtaaaaatatacaattatagttacataactattaacacaaaatatgcctacacttataattgtataaatatgtaattaactataattgtattaccgtgtaactattaacacatttataaaggtgttgtgtatatatatataaaaatcatataaaatggtttttgtgagtgaaaaacctcaagttttattaacagtttcttttgaaatgctatgtactttgaattactcaagtaaaaggtgagcgtgctctctcggttcaaaaaaagtacgtatttgtatttatttattttttggggacaaggtcttgctctgtcacccaggttggagtgcagtggcatgattttggctcactgcaagctccatctcccgggttcaagcgattcttctgcctcagcctcccgagtagctggaattacagatgtgtaccaccacacctggctaatgtttgtatttttagtacagatggggtttcaccatattggccaggctggtcttgaactcctggcctcaggcagttcacccaccttggcttcccaaagtgctcagattgcaggcacaaaaagtacatattactaataaactctgtctttacctccattaataatcctattcttcttcactgaagttgctaggccttttctctgcagttaggtacatcactatgcacctatttttaaaaaaatacatgacgttttgtggtatgtttctttgtttttacaaactgtatatataatacactaagtattattttatagctttccttttttccccactccacattgtctcagagaactttcatgtcagtatagttctatataattataagtaattaagaaacacaaatatgataattataaaatataaataatactgcatatatatatatacacacagtacatagttatttgtagctgcagtacagttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaaggtatgttaagcttttggccttcatttaatataataaaaatttagtgcctgttttggagaaggtgctcagctaggtactgtgttatgttgtgcctaatgcttcatcacattttattggagtccataaatataatgtcaatttaattgtagagagaaattttatgaggctaaactacagcagcaacagagagagctaaaacaattgcaggaagaaagaaagaaactgattgacattcaggagaaaattcaagcattgcaaacggcatgccctgacttacaggtaattatgaaatttatttctaattgtctgaaaaaagatgtttaaaaccttaggtcaactgaaagtactcttttttgtttttgtttttctttttttttgaggcagagtctcactctgttgcccaggctgaagtgcagtggcgtgatcttggctcactgcaagctctgcctcttaggttcacgccattcttctgcctcagcctcctgagtagctgggacttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttcagatagttttgatgagcatctggtttcagaatcattggtctggatttttgctgtccagtatggcagccactagatataggtggttatttaaatttcaatcaaatgaaattaaaaatttattttctcagtcatattagctgcattttaagtgctcagtagccatgtgtacctagtgtctactgtattggatagcacagatacagatgattgccgtaattatagaaagttctgctgaactgcactgatcttgaaaactccctcaagcaaatgttaagggtagtttagctttgggaagtagtcccaggggatatgatgattatttaaatgtatttgaagaattgttttgaggaaggcaaactaaacatattctgtatataacagcaatagggagagtgccacccgtagcatagttattgtgattaaatgaaattttatatacagacatgtatatgtatgtttgaaacaatgtctggcacatagtaggtggcagagtatttaacttatctccagaatgacatctgttttatgtctcttaatcactagaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggttagtttcagtattttaattttgtgcttaatttaagaggctcaggtctttttgactgacagcaagcacttctgcagttctccaagccaactgaatgtcctacaactcaattcaatttttacactaactactcagagttagtgcagacccctcaagttaaggggctcagttcagtaagactgccctcacctcagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtatcagagcagtttgtctgcatgcttttgaatcatttttttacatgtattcttcctgaatgtactttatatatatggcaatataactgattcttagattactgacttaaatctttgtaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtaggtgacttaacctaaagagaaaataaataaaagcaaagtgtttggaacaacgtaatttgtctattgcctagatgttttaacattttcttttggagtggggtaggaaatgtttgcaaagaaagttacaaactcttttttttttttttctttttgaggcggagttttactcttcttgtccaggctggaatgcagtgacatgatcttggctcacggcagcctccacctcccaggttcaagggattctcctgcctcagcttcctaagtagctgggattacaggcatgtgccaccgtgcccagctaattttgtatttttagtagagatggggtttctccatgttggtcaggctggtctccaactcccgacctcaggtgatccacctgccttggcctcccatggtgctgggattacaggcatgagccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgccaaaaaaaaaaaaaagagttgatatttaagctaaagaatgaatagaatttatttccagagagattagaaatgaaagggctttctaatagaaccacttagagttataaagcaatgaaatagtacatcactcagggaatttagaggtatttaagtgtggctagtatttaggggaagagtaattgatgtggttgaagagtggcagagagattttatgatgtgcaaacaagcttaggttttatattgcagacgagggtgccattgaaggactttgagcaagggataacatgaaatttatattttagaaagattacactggtgaaagtgttcgggagaagttggaggaaaggagtgaagatttagctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattggcagcaaacatcacatgagtagacttttaagtaataagaaattgcaaatgctcttcctttttactaaaatatacttcatacccacaccaactctatataaaggctcttcattcttcttaacagtacaatttttgtgaaaccttcccagtctctttccccacacgttgttagtagcctcttgcaaatagctctgatacataacagtatttggtaagtatttaattatattctactttcccaataaaaatagagtagaaacaacataagcgtaggagtcatacagacctgagatctaatcatctttttcatttattagacgtttgatttctaaccgtatttgctcactggtaaaatgaatgcagtatctattttataagttacttggttttaagtattaaaccaagtaacatgtaaagtgcctgcagtagagtgtgtcacccagtaattgataaatgtcaggtaccattatttctaacttttagctcttaagggagtggggattattaattgtctttgaccaatgcctaaaacatagtggcctaagctgtgaacagtgattggataaatattagcttttttttttaattaacagttttttgttttggtggatttgaatgacatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggtactgattgtaaacagtcttttattgcttaaacattcacttttgtgattacatctaattatgtgtaatttgaaaacacaactagggaggacgtttgtgatgatttggcttgatgatgttggaaatatgaaactttgacgtatcagtagatgagatgccagatacttcctggtaaccctggtacattaaaagttgtttggaaggatgtggcgtaactcataggatttgttttgtctctaatttgatacctgtctttacggttaaagcagtttgctgttcaatgacttagggctggaaactaatattaactgctagaagatagttgttaagtgatgatccctttttttgattcctagctcttgattagaatcacttcctaaagcctattcaaatataatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagctctcaggtcatatggaaacaggcagcaggctgaatttggtctgtaagttacaggtttctaacccttgtcttgagttaaatcctgtaggtcactgtctcccagactattaggagcagtgttgttgttcacgctaggttctgtgataaagttttggacttgttgcccactaccacttttaagagatttataaagcacattggcatattaaaagttgtgagatattttacagacctgtttaactttgttttatgtgttttctccccaacctagacgaccgatgagtacctattaaatattaagggatgctagtgttcagcagataaaatttgagaaatgacagtagactaatagaactacggacttaaggagtggagaaataaattgctaattgaatgaccaattgtattcaccaaattcttgttctacttgaactgctttaggtgaacacaaatccatgtatgttcccaagccctctgctatagctctttttgagccattcttccaacttttgggtcttgtatatcccatcctcccttgatttttctttttgttgttttttctagaggcagggtctcactttgttacccaggcaggagtacagttgataacgatcatagctcactgcctccttgaattcctgggctcaagggatcctcctgcctcagccccctgagtgtctaggactggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaaagcttcagttttgtagattattgaaaaattgccaaatgcccacgtttactattttttttcttttgctattgtatcagatcctgcatccaactctttggtcatgacttttagatggattcttgattgattagtttaaagaatagtgggcttctaaatacattgcagtttttgaatatcatatgataaaaccagttttaaaacaggctggcttaagtccttctggaagtaaactcatattttactcagtcttgccattgaatgtcatattaaagttgtttaaaaaatttttttaaaattttctttatggtgttagtcatacctcttacaaaaataggttttctgtgatttttgaattatttactgaagtgtagtactaggttaaaaatagtttcattagctaaaatctgcagtgttacagctgaaggatattctttttatgtttgcaaaggatgggctatggccttgaaaggttgttctgagtttaaggagatagtatttggtgcctaaggctagttgcggtggctcatgcctgtaatcccagcactttgggaggctgaggcaggtggatcacctgagagcaggagtttgagaccagcctgaccaacatggtgaaaccccatctctactaaaagtacaaaaattagccgggcatggtgggcgtgcctgtaatccagctactaaggaggctgagacacaagaatcgcttgaacctgggaggcagaggttgcagtgagccaacatcatgccactgtactcccagcctgcgtgacagagcaagtctctgtcagaaaaaaaaaaaaaaaattggtgtttaagaacaaagtattctaggcttataatcaggaaagtttgaaatgcattgcacactgctaactccctttcttggaagttcacaacacatacaagtatagtaaatgccctgagaaatcctgtagtaagaaaatacacttgtaaactttggcaaccttcatcttaatcacttttggataatgaaaccttagaaaaatctaatgaaaaccacagatacaagagaatattggcacatttttaaaaatttcagtaattcatctatccttgaagtccttggctcctaccttgaaccccatgtgaagaatctgacggatggtttaaaaagcaagtttgaacaggagtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcataaacttgagtttcacatgaatctccttaggaatacagttttaagtgcagattctgattcatttgacttggaagggacttgagagtctgccttcctaacagactctcttgtgttgccagtattggtctgtggactacacttcaagtagcagattttacaggaaccttagctaatttatggctatgaccacctaaccctagaaatattggtatgttttaatttttctgaaacccctttattctcgggaattacttttccaaatatataattcagccttttaacttcaagacaaagattgacattctgatctttgtgctcttgtccttcatattgaagtataaaaatacctgctgtttgaaatgtacagtcacatttgctcaacaagcattcaagaccatctgtcagtgagtgccccactttaaggcacacacacacacacacacacacacacacacacacaaataaaaggcttgatagcagaatcaaactatacatagcagagccgaagtaatatggggtaaaatcaaattagctcaatccttgctattcaaactctgaactgtggacaagcagcattacatcatctgggatattattagaaatgcgtgcttttgggcctcaccttatgccaactaaatcagtatgtatttttcttcagtatgcattttggcaagatttttggtatgaagatatgtacgtgaaagtctgaaaagtactgaactagaacactggtttatgtggtttttgttccttttgtgctataggaatggtcaagatttgttagaaaaaaggatttttactgtatctttaacctccacctcccgggttcaaacaattctcctgtctcatcctcccgagtagctgggattacaggcatgtgccaccacacccggctaattttgtatttttagtagagacggggtttctccacgttggtcaggctagtcttgaactcccgatctcaggtgatccacccccattggcctccggaagtggtgggattacaggtgtgagccacagcgcccgaccaatttttattatatcttaaaggaagtggtaaatagaggtgggtggggaaaagtttagaaagcctttcaaattgttactacagtaagaaaagtatagagtggggaacaagcaggatgagaggaattgggaacggatatgacagatatttcagcatagtgggaattacactgctgtcttgagagatatggtacagccagttatactgtcccatacttactagactgatccaaatatatatgtgttttttgtgcatgttgacattctttcagaagtagcttgataaatctcatataactttgtttcccatgatggtaatgtgttttaatccttagaaggtctttatatatgaaaatagatattgcatatgaggtaagaatatataaattatgtaataatcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagactcagtctcaaaagaaaagaaaaaaaaaaaaaaagcagttatttgagtgtaataaagactgttagccagtgtacatcattgtaaatgaaagtactccagagatatttctatctcagttaggaactaaacagggattccttctgtcccaccatcattatttaccattatttgggaagcattaggtcaaataattggaattataatggtagtaaatattggaaaaggaaggaagcaagttttatgtgttcttttctagtggcatttttgtatactaagaaagcccaagagatactggaaagtagctcctagagttacaaggtaaactgttaaagtggctggttatggaataagtgtgtgaatatttttctctgttgtaatatccagtagcatgaaagtggagaggaacgctcttctcatagtagtactctaagtgtttgagtggggggtatgaaatgtaaggaacaaatttaacaaggaaagtactaggtctataaaaagctataaagtatttttgaagaacatcagaaagattgaacaaatataaaaacataaccatgttcttaagatggaaaagatggaaatgcataagattattaaataccatttctcctgagattaatacatacttttaatttgattccattttgagtccccagagattgtttttaaaattaaaaacaaaaaacaacaaagcttatgtggaaggacagatgcccaagaatagtcaagaaaaaagtgaagctagtgggacttgccttagcagatatttgatcatcctgtataacttgtgtttctaaatgaataaaaatggcattggaatagctaagttgaacacataaatgtccaaaagtaaaaccccaaatattggaatttaatatattgaccgatgtgtattttaattcagtggaaagagggtaggtatagccacctatccatgtggaacaaaaaaaaaaaaggaatttctaccttgtatatataccaaaatattttaaaaacttgaaaattttatagaatatatgtataacctatcagtgggtaagaccttttaaaccaagtcatgtcacataaaagataacaataagaaaggcaaatgtatttgactactctccctctataatggatatttgtatatatcggatgtgattcttatgtctcctaatattaaaaattgctaacttggaattctagtagagatttggggtcatgtaaggtctgccatatacttcgaattggaatatactcattaagatgagtatcaaagaacagtgaaggttagatttattactgttagctcatgcttccaaagggtattgcaaagatacctccaagacatatttactgttttgtattctatttataccaggccttcctagcattgtaaattgagttacctgtactgttacacaatggaaaccgatttcccttttagtttgagttagttgcaactgataacagttgtcactttttttactcaagggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcaggtatgttcttttttggtttgcattaatataaggaggttttcagcttagatttgaaaagctataataaagcaggtgttaaaattggtgtttcacacgtatctatcatgtggaaggttttatagtggaaattatagtacacattccttgatactgaaaaataaaaactgaaaatattttgtgttatactatttaatagttttggacacattttaataaaattctaaacaaaggatagttacaattgtggaactcttcaaattctgaaaatcttatctgattaagaattagatatgaaatcatgtcatctcctgcttcaatcctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtcccttggcagcagataaaagcaccagtagtttcctaatttgtaaagagcatctcaaagaaatatggagagagagaggcaataacatgacattagactatagtggatagaccttaatctagtagctttcattgacattagtataaaatgcatgcgttttttgtttaaaaatgataacagcagctatcttttgtaccatgctccattattttcaaattaccaacaaatctcatttgagcctcataatgctgagttggttttatttccatttttcggaggaaacatggtcaaagagggaacttttttttgttttgtttttcagtactcataaaggctcagtaatgtaaactggtacaactttcctggaaagcttcagaagtcatgcccttaatccagtaattgtacttgtagtaatccatcctaagaagacaaaaggggaaaaaaaaaaaagacattaagatttagtgttgtctcaacagtatggtttcaactatgtataaacaaaaatttgaaagcaaaaaggccggaagaaaatgcatcaaaatgttaatagtggttttatcatctttaaactcataatgagcatttatcattttgtaatcagaaaagaaacatcacatttgtttgcattttgaaatgaatttctcaagcttacattgctaggaaatggtaaagctgaacttagaagctgggcttctgttaagtctgtgttcctttctgcaaaaatatcaatcctattcttctgaacccagaattttactaaaattttataattttcatctccttttactctctaccaaatagtgatatcttcaaaaaataaacagtccggtagaggtcgaagaaggacactaaactgaaagtcttaataaactgagtatcaattacttaaataataattggacatagtacttcaggccctattactgttacttagtgaaatataatgattgaattttggtgaattaaaaaatgtttgaatatataaatatacacaagtttacatatttacattctgaaaagattaaaaaaaaaatttttttttgagaccgagtctcgctctgtcatccaggctggagtgcagtggtgcgacctcggctcactgcaacctctgcctcccgggttcgagcgattctcctgcctcagcccactgagtagctgggactacaggtgcgtgccaccacgcccggctaattttttgtatttttagtagagacagggtttcactgtgttagccaggatggtctcaatctcctgacctcgtgatccgcccgcctcggcctcccaaagtgctgggattgcaggcatgagccaccatgcccagccctgaaaagatttatttttagttttaatcattaccctaaaattccttatagcatgtaaggcatgttactttttgtaactgtactcataacatatgattattagagtatagcataataggactgctagtattaaattacgcagtcttcttctcccgtgggtgttgtgggaggttcaccttgatgtgtatgcttctaaaaatgaatgatagaagtttattatgatagtcatcatcggtcgccttaatatacgtttatagcaaaccttttgagattttttttcttgagattatttttaagtagagcgtaagccttagttcaggcaaacaattttaaagaaattcgcttatttctttttttcattcacttattcatgttatagaccctgtctttactactcatacacattttatgttcatccttatgtctgccctttcctacagcacatgctaggagaatactacagcagtctaacagaaatgcatgcaatgaagcgccaggtaacaatctgcgtagttttggtgtccactttttgttaattttttcccattggtcctaaaggttttattgtcctgatttttttcttttttaaatttagctgagagtatatatgttatgtgactattgtaaaagataatttatattcataaaattctgaacccattcatttataattcttggtaaaatttgctgcttttgttttcatattctgttagtgtatgtaacctaacacattcataagggtaacagaaaccttttttacggtttagtacttgatttgaggttattttgtacttcttcaaagcattagtatttcttagacctagaaatatagttacttttatagtttatctttccatttcagtcagcatcttagaaaagtcatcaaacaaaacaatgattacatgcaaagacgtgataaataaagatcatggaaattacaaagattcccaaatactattttagtctctaatataagtattctcattaaatgtggttctttgtgatttagagttgtaaatatttttttaactcctcttgcagctttacatgaatgaaaagtaaaagccagtttgaatggaacctttaggggaatctaaagatacaaaacaaggatccagaactgacaaagctgaatatatcagtggcactttgaaaataaggaactctgaaaataggatataaaaacaagatggaattagagaaacctgattaagattagggatttttccagccaaagctaataaatttcagttcaggaggagaaactggcataaactttccacctcttgactgcagaagtggtgggggaatgaagcttgtgtttaaatggcatattcattatttgagaataatttaatttttaatgatacgcaatttagattgataattttatcacatacagaggtattaaatatgtcattaaacagttatagctttgaaatgaattttttaaattaagtatgattaaactgcaatatagtatataagataaaagtttgcatatcaaaattctttttacctggatttttcccattagaagagattgcttacagagataattttggttcctgcttattataataagtgtcatttttgtgatagttcataccttaaaactacgagaactttagtgtatcacttgattttatacctgtaactgaggcaaaatagggaagttgcatatttattgttacatataattaatatatttttctattgatatcttatattagtaatgttattatttcatgcttgtggaaattgagacctgaagatattaaattattagccaagtagtggaaaatttttctattagagcacattctttttccattttcttattcctctcacaaaaatgagtttttatgatcttgtatacttctttgaaagcgcaatgtattaagatactcaacattttaaatggatacctttgagtgtaataattttgtgttatcaacaagtaaatttagccgaattgtagctaaataatagagtgatgcctagattctgtgaaactgaaaacttcagttggatcacttgcctgctccaatatacactgagtatgtaaataagacacaatggtgaaattgacctattatgttaggttacagatttggttactcatcatcacagcacttttctgtgtgatgtatgagatttgataattagtagactatactggatagaccttaatctagtagctttcattggcagcattcagtttattctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaagctctgaaatagaattgtctaaaatagaatttttagataatttaaagctgagagtaatgatactagctaataaaagttgtcatgaaggtacttcatcaatattaactttctggtcttttatgtattccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggtatctggtacctaacataatttttcctaccctattatcaccttcttcatgattatctctggttgctgtcttagactgaagcatgtgccatatgaattttcatctgttctctatgtgctttcttgacattttatttaaaatttttgtatagcttaagtagcattaaagtattttttttgagtactttttcagtgttttgtctacttcctcacacttaacctgtgagggtagaaacagtacatttttccttccatctgcttttatttttgaatctgtaatataaatgaatgattaagcatgtatgttttatataaatgatgatcttattttcttatttaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaaaaaaaaaaaaaaagcctagacaaaagtcttccaggaaaaaaattgtaatttaatgtattctaattcatggagaaaattttgaatagagtaaaaaggacctggaaatggagaagagtgctaaggagaatggtataaattcagtaagctgtgtcctccaaatagcacttagcacatcgttgattgaataacagtgacagaactgctagtatattgaggagataatgtgctaggtgtttgggaatcacctatttcaaggttcaggccttgattttattgtaaaatatttcatgtggtcgtgggatagcaaatacattcctttttttatgacaactctagcacctagagatacatgggtaagagtttcgtagttgattagcaaatatcagctataggtagagagttggaatttactgtttctgccttttgttgaagtgttaatactaagttttttctgaagccagtgttttctcaaaggattgtctttccttttcagatacagtaatttctgagtttttctgaatttttgctctttaacttctactcgtgtttaaaataataacttccccagctcatcttttctgtttaaaatgttttcccactggactctgactcctttagtactataacataaacctgtgtctaaaaactacatggttttaattaactttgcaatgtgaaatgtaaattagtgtcagtcagtgtttgctcctttggattgttataactaattgaaaattgtgtattcctttttgtgggaaatgaaatgcgacctgcttgaatacattaaaaatagatgttaaattatattaaggtttattgggcactgaaacaacttgagagagaatgaacagtctccattcctagacgtatttttcaataattttatatccttaattccagtgctttcacttttatccaagtttcatacaggcagcattacttccatttattttaagagattggagcacattggtttgcaccatcgatagcacattttgaaagttgagctacagtttaggataaagttaacctaagaaggttttaaagttaaatgaaatttaaagatgctgtactacttgatacgtaaggacttgggatagtaattgtatttagtattacttttaattaagtaactaaatcagttctttgatatttcttccaaaacttaaattcagcattaaggtcaacatcttccctttactaatgccatttaatcagcagcaccacaatatccagtgttgatactcacagatctgaagcagcagtgtccagtagaactttctatagtgatggaattgttttatgtctgcattgtctaatgctgtagccattagctacatgtggctagcaagtacttgaagtatagctattgtaactgaggaactaaattttaaattttatttaaatagccatatggtgttttttgtattggacagattcagagcctcattctctagatgcttctatgcttcttgagcttcatttttggagcttttacaaacgtatattaagatgtgtaagagatacctctcttgcctagggaagagagaaatgaaagtgaaactgggaatctgggagctgtaagtcaaggaggatggagtggagacactgaggtttaggaagaagaaaacacactttgtgtctcctgctcccgatgataataaaatggtaaaagcacatctgtcttgaagacttgaagcacatcaagtcttacttgaaacagtaaaaaaaatggtttccctattcctaaaatacgttccttaatgtctaaatttcctttaatcagggacaaatgtttgatttcataattgaagataggaaactttaaaaagatcattagttaagggaaagaacacaactgtaaaatgtcataatcaaagtgtaagtgagacaccctaccaccatcacactatacacaaaattaatttgaaatgacctaaagtcgtgtaaaagccaacactattaaaacttttaaaagaaaatgggaaaaaattatgaccttgacataggctaagttttcttaggacagagaaagcactaactataaaagaaaaaattaagaaattagacttaacaaaaataggaattttctgcttttcaaaagatactgttatgggaaaataatcccagtatatatatctgacaactgtctgatatatagactgtataaagcttacaactcagttgtaagacaactcagtaaaaactgggcaagagatttgaacaggcacttaatgaaagaagatatatgaatggctaatatgcaaattaaagccacagaaaataccacttcacatcaagaatggctaaaatgaaaagattgacaataagaagtgttggtgagaatgtggaacagttggaactctcacagtccttatgagaatgtaaaattgcacaaccacttggaaagcagtttggcagttgcttataaacataaacgtggcatgtgacccagcaatttctcttctaggtattcatccaagagaaatgaaaatatgcatcacaaaaacacttgcacattaatgttcatagcatctttagtcatgatagcctcaaactgaagcatcaagagataaatggataaacaaactgtggtatatctatacagtggaatactgtgcagccattaaaaaataatttctgaacttctgaaacacaaaacatggattcatttcagaaacatactaagtgaaaagtcagacaatgaagagtgtatattggctggttccatttgtatgaagttctacaaccagcagaactgatctacagtgatagaaatcatgagtagggtgtggtggagattgactgtagagggttgtgaagaaacgtcctgggccagtggaaatggtctttatctttagggaatctggttacatgagtgtatacatttgtcaaaactcatcaaactgtacatttaaagtgagtgcattgtatattaattatatttcaataaagtttattttttaaaaatgcaaatgatgttgtgatgttttcttttctgatgtgagacaaccaggtagagtaagctactagacattgttagcatttggagataggagaatgtccctgagagtatagaaataatgtaaaatgttaactttgccaaattagaatttaatcagtagctgtctttgtgtgtgtttatctacataataaatattctgcaaggctacttatatcactgttctctgtgactctgtattcagcgtttaataactttggttatattatcatcttgtttggacagaatactgaggaaacttatgaatatcttttaagtgtacaattttatgtaaatacttagttatctctgttagattattaatatgaaattcttagaagtattagtgatttttgtttgttttactgtaacttaggaaacttttgagaagaactttgaaagagaaacccataaaataagtgagcaaaatgatgctgataatgctagtgtcctgtctgtatcatcaaattttgagccttttgcaacagatgatctaggtaagcagaattgtttataatcttagaaacaactttaagttgatctggtccagtctttgaattggcgttgataaggaaacaagtctagaaaggcgaagtgtgtgtggttgaaagaatgtggacttaattatctatcagtctaaaatcaagaatcttctgactcttaaccctgtgagcaaatcatccaacatttttgactctgcatatactaaggaaatgggaattttaacctaccttgctatgttcttgtgaaaatataatgtaacttacttgcttgagttcagaaaatgttaatttccttttccttaaaggaaaggtcatcgtttaaggtcatctagttaattcatgggaacaattcaggcctcatctaatcatatttttaataaaaatattaactttgtaatttgagttaagcagtcagttttcttaaataacctgtagtgaaaacctcaagtaattctcaggcatagcaaatggttttggttgtttttttttgtttgtttgggtttttttttttttccccctctcccatcagctgtaaaacaaaagaggtttagagggttgcctggctgcagtggagaaaaaattcgagtcctagacttggaaaggaaatttaaggaaaagaaaaatatgtagatacttgatacgtttctagactgtggccaatcaaaagagaacctgagaattcagtcatttgccatccagggtgcttagttgataaaataatgtaatgtcctgttactctagtgtttgttcacgtgatgaagagaagacttagattatttcaaaggtatttttccactataaagaaaaggacttagccttgccctatcattacattcctactgttcgccaaaacaaaagtcttccttttgcttattgtaattattgaggactcagccttagctgacctctaagtaaatgcttatttgggtctgcattgagttcatcccattacagagaaaaattactgtgtggcctgccaaccctcaccccttaggttgtccctctctttctgagttgccagaatacttcgactcctacgtattttctttcatttactggtatttttttttttttcttacaaacctgcaccagtagctgtgtctgaagtagacatagaattgggaaatttcattgataggcctttttcttacctaatttgcttgttttaggttgcgttgttttcatcagaatttgcatgacattttggaattcacttgtattgtttaaatgaaacaacaaaatgaaataaatatgggcttcagagtttgataactaagtttaaatccttgttcctacattgaactgtctgtgaaagcttgagcaagttacttaaattttctgcaaatgaaagtaatgtcatctactatataggattattttaaggattaaataagtgtgacaatgtatatgaagtgctcaagtagtatagtgtgtagaacttgttaaagctaattttcctcccttttgtttggacatttttttattaatgcattttgaggaatatatgaaaaagttcacttttacatactcaaaaaatatttttgttccaaatgtaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaaggtatatatttttgttttcggtaggtttttggagaacaggtggtgtttggttacatgaataagttctttagtggtgatttctgagattttggtgcacccatcgcctgagcagtatacactgtacccagtgtgtattgtttgatccctcacccccttcccaccctttcccctgaaaccccaaagtccactgtatcctgcttatgtctttgcatactcatagcttagctaccacttatgagtgagaacatgcaacgtttggttttccattcctaagttacatcacttagattaacggtctccaactctacccagatggctgcaaatgccattactttgttcctttttatggctaagtagtatgctgtggtgtataaataaataaacaaatatatctgtctatctacacatatatacatataccacattttctttatccgctcgttgattgatggacatttggactggttccatattttgcaactgcagattgtgctgctataaacatgcacgtgcaagtatctttttcatataatgacttcttttcttctgggcagatacctagtagtgagattgttggatcaaatggtggatctactttcagttgtttaaggaatcttcatactgttttccatagtggttgtactagttagtttacatgcccaccagcagtgtaaaattgttccctttttaccacatccacactaacatctattattttttgatttttaaattacggccattcttgcaggagtaggatggtatcacattgtagtttgtgctttgatttgcattttcctgataattagtgatgttagagcattttttcactcaacatcaccaaaaagttttttggccatttgtgtgtcttcttttgagaggagttgtctatatccttagcctactactactacttttttttttttttttttttaatttgagcacagtcttgctctgttgcccaggctgcaatgcagtggcacaatctcagctcactgcatcctctgcctgccaggctcaagtgattctcatgcctcagcctcccgagtagcaggcattgtaggcatgtgccaccatgtccagctaagttttgtatttttagtagagatgggatttcagcatattgtccaggctggccttgaactcctggtctcaagtgatctgcccacctcagcctcccaatgtgctgggattacaactgtgagacaccacacttggccttagcccactttttgatggttttttttttttttttttcctgatttgtttgagttctttgtagattctgggtattagtcctttgtcagatgcgtagtttacaaagactttctcacactctgtgggttgtctgtttactcagatgattatttcttttgccgtgcagaaactttttagtttaagttccatctgtttatctttgtttttgttgcatttgcttttgggttcttggtcatgaagtctttgcctaagccagtgtctataagggtgtctccaatgttatcttctagaatttttgtggtttcaggtattagattttgaaggtatattttttattgattacaagtaataataattctatgtaaaaaatttaaatatgtgatatctaatggtggttttattactactttattttaattgataggggtgcttaaactacaaacatgtttctttgtattatgttagcataaaatcatcaaatttaatatttttcaaatttcaacataaaggcatatatgtatatataataggctttgttaggctaatgtattttctttttaaaaattagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggtaagcaattattttaaaaaataaacgaaaccttctatgttttgttttttaattcatacagaagaccttattgtgataaagttcaacggtataggtaaacaacaacaaaaaaactatcacccataattttttcaccctaccaacattctctgaacctttcagtaatattttatacacatgtgcatattctgcctttttcatttactatatcataaacttctttctagatcattatttttctgctgcattttttcaggatttatcacctttatttttagttttagtttttgtgagtgtatagtaggtgtgtatatttatggggtacatgaaatagtttgatacaggcatgcaatatgtaataatcacatcatggtaaatggggtatccatcccctcaagcatttaacctttgtgttacaaacaatccagttatactcttttagttattttaaaatgtataattaaattattgactgtagtcaccctgttgtgctgttaaataatagatcttattcattcattctgactactttttgtacccattaaccatcttccctattccctactacctttcatagcctctggtaaccatccttatacagtttatctccatgagttaaattgttttaatttttagctcccacaagtaagtgagaacatatgaagtttgtctttctgtgcctggctaacttcacttaacataatgacctccagttccatccatgttgttgcagatgacaaggtctcattattttttatggctgaatagtactccattgtgtgtctgtaccacattttctttatctgttcatctgttgatggacacttaggttgcttccaaatcttggttgttgtgaacagtactgcaacaaacatgagtgtgcagatagccctttaatacactgatgtcttttcttttctgtatatacccagcagtgggattgctggatcatatggtagctcttgctgtattttcagttttttgagcaacttccaaactgttctccagaggggttgtactaatttacattcccaccagcagtgtatgaaagttcccttttctccacatcctcgccagcatttattattgcctgtctttgggataagtgccattttaacagaggtgagatgatttctcgttgtagttttgattgtcatttccgtgatcatgttgagcaccttttatgtgcctgtttgccatttgtatgtcgtcttttgagaagtgtgtcttcagatcttctgcacattttaaaattagattattagattttttcctatagagtttgaactctttatatatgctggttattaatcccttgtcggatggtttgcacatattttctctcattctgtgggttgtctcttcactttgttgtttgtttcttttcttgtgcagaagctttttaacttgatgtgatcccatttgtctgcttttgctttggttgccagtgcttgtggggtatcactcaagaaatttttgcccagaccaatgtcctgcagagtttccccactgttttcatataatagtttcatagtatgaggtcttagatttatgtctttaatccattttgatttgacttttgtatatggtgagagatagaggtctagtttcattcctctgcatatggatatccagttaccccagcaccatttattgtgaagagactgtcttttccccactgtatgttcttggcacctttgttgaaaatgagtttattgtaggtatgtggatttgtttctgggttctctgttctgttctatcggtctgtgtttctgggttctctgttctgttctgtcggtctgtgtttctgttgtttgtatgccagtaccacgctgttttggttactatagctctgtggtataatttgaaggcaggttaatgtgattcttccagttttgttctttttgctcaagatagctttggctgttctgagctttttttgtggttcctataaattttaggattcttttttctctgtgaagaatgtcattggtattttgatcacaattgtattgaatctgtagattgcttcggggagtacagacattttaacaatattgatttttccaatccatgaacatggaatatctttccctttttgtgtctttttaaatttctttcatcagtgttttatagttttcattgtagagatctttcacttatttggttaattcttaggtatttaattttatttgtgtctgttgtaaatgagattactggtggcatatagaaatgctactgatttttgtgtgttgactttgtatcctgcaactttactgaatttgttgatcagttctaatagtattcttgtggagtctttaggcttttccaagtataagattatatatatatcatatacaaacaaggataatttgattcttcctttccagtttggatcccctctatttctttctcttgtctgattactctagctaggacttccagtactatgttgaataacagtggtgaaagtggacatccttgttgtgttccagatcacaaaggaatggctttcagtgtttccccatttagtatgatactagctgtgggtctgttgtatatggcttctagtatgttgaggtatgtttcttctatacccagttttttgagggcttttatcatgaaaggatgttgaattttatcaaatggtttttcagcatcagttaaaatgatcatatgggttttgtccttcattctgttgatatgatgtattacattgattgatttacctatgttgaaccatccttgcatccctgggataaatcccacttggtcacgatggatcatctttttaatgtgttgttgaattccgaggtatcggttgtaatgtctcctttttcatctctgatattatttgggttttttgtctttttttcttagtctggttaatggtttgccaattttatgtatcttttaaaataccaactttttgtttcgttgctcttttgtattttatttcaatttcatttatttctgctttgatctttattatttcttctattttgggtttggtttgctcatgcttttcttgttttttaacatccattgttttcgtatctgttatatgtatgtttttggatttcaggttaccatgaggattgcaaatactgtcttataactcagtattttaaaccgataacactgattgcataaacaaacaagcaaacaaaatgaaaacttatgcaaatgttaactttgtttccctgctttttaactctttgttgtttctctttatatcttactgtaccatgtcttgaaaagttgttgtagctactatttttggttggttcatcattttgtctttccacttaagagtagtttacacaccacaattacagtgttataatattctgtgtactttctattactggtgaattttgtaccttcagacgatatcttactgctcattaatgtcttcttttagatggaaataaagtatttagtatttcttgtcagacaggtctggtgttgatgaaatccctcagcttttgtctgggaaagtatttctccttcgtgtttgaaggatatttttgctggatgtactattctagggtaaaagttttcttccttcagcacttgaaacatgtcatgacactctctcctgacctgtaaggattctagtgacaagtctactgccagatatattggaaccccattatatgttatttgtttcttttctcttgctgcttttagggtcctttctttatccttgatgtttggcagtttgattattaaatgccttgagatagtcttatttggattaaactatcctggttttctgtaaccttcttgtacttgaatgttgttaagcttactacctctgtctctctctaccccctctttaaggccaataacttagatttgtcctgttgaggttattttgcagatcctgtaggtgtgctttattgtgttttactttttttttcttttgtctcctcaagttgtgtgttttcaaagagcctgtcttcaagctaattctttagcttgatcaattctattgagagattgatgcattctttagtatgtcagttgcgtttttcaactctagaatttctgcttgattcttttaaattatctcaatctgtttattaaatttatctatgaatatagaattctgaattcccggccaggtgctatggctcacacctgtgatcccagcactttgggaggctggggcgggtgatcacttgaggtcaggagtttgagaccagcctggccaacacggtgaaaccccgcctctactacaacatacaaaaaaaaaaaaaaagtagctggacatggtggtgcgcacctataatgacagctacttgggaggccgaggcaggagaatcgcttgaacccgggaggcggaggttgcagtgagccgagattgtgccaccacactctagcctgggtgacagagcaaggctccgtctgaaaaaaaaaaaaaaaaattctgaattcccttcctgtgttatcttgaatttgtttgagtttcctcaagacagctattttgaattctctgtctgaaaggtcacatatctctctccaggattggccactggtgccttatttggtccctttgttgaggtcatgatttttggtccctttgttgaggtcgtgattttctgtatggtcttgatgtttgtggatgtttgttggtgtctgggcattgaagagttatatataggccttgtatcttgtaggcctcacagtctgggcttgtttgtgcccattcttcttgggaaagctttccaggtattcaaagggacttgggtcccaagcccaaaaacactgtgctttttgcagactcatagcggtataccactttggtgattttggataagatccagaagaattctctgaattaccaggtggagacttctgttctcttcctttactttctttcaaataaatggaatctctgtgttgaaatgcctggagctggatggagatggggtgatggaggcacccctttggtgacttaccactgtgactgtgctgggtcatacctaaagccagcacagcacagcactggggcttgcccaagaccctctgtaaccactacctgactaccgcctaaatttgcctaaattcgctcaaggccctagggttcctactattagcaggtggggaagccagccaggtttgtgtctttcccttcagggcagtgagttcccccaggtccctaatgggtccacagatactgtccttgagcttagaaatctacctggtattctgtcctactgtggctaagctggcctttaaaccacaagacaaagtccttcccacttttacctctgctttccataagcaaaggagtctctcctggtggctaccactgtgaccaccggcccatgagttctgctaatattcatttaaagcccaagggctttttagtcagcttgtggtgaatgctgccaggcctgggactcacccttcagggcagtgggctctcctctggcccagggcaggtccagaaatgctgtccaggagccaggttctcgaattgcggatcccaggagcctgcttggtgctctaccccactgtgatcgctctggtacttaaggtgcaagacaaagtcccctttttcctctacttttctcaagcagaaggaatctttcaccatagccatcacagctcagtatacgttggatctcacctgaagccagaacatctctgagtctcacccaaggcccatggcatactacatgggtatcactgtcagttattcaaggttcaagggctctttagtcagcaggttaagattaagccaagattaatccttccaggactgggtctttccctttaaggcagtgggtttccttctgggccagagtgtatctaaaaatgtcatcttggagctggggcctggaatggcgacctcacgactctgccggtgccctgttgtagctgtggctgagctggtatccaagatacaacacaaagtcctttttactccttgctctcgtctcctcaagcagaaggagtcacttgcattgctgcagtcagtgctgcctggggttgggggaggggtggcgtcagcaattcaagatggtctttcctaccctcagtgtccctttcagcaatacaaagttaaaagcaggtaccatgattgctcacctggtttttattcttataatggtgctttttttgtgtgtagttgttaaaatttggtgttccagaaggggaagatgattggtggaggcttctgttctgccatcttgctccacccctgcctttttttttaatggatccacaacattcattccaaaatatttataaaatgcctacttaatgccaggtttggcagacctagcagtgaacaaggcctttgttctcatggagcttgcatgctagagtgggaatacactctgaaataacataagtaaataaaagacatataagtaactgtttatcagttaatgatacaggccatgctcagaattaaaatttggtgatatgatggtgtctgttttatattggatgatcagggaaagcttctaatgagggaacatttaagtagagatgtgactaaggagccagtgtaaaccaggattgttctagacagtgcactggccttaaggtgagaattagcttcgcgtgttgaaggaactagagggaaagtctatatggttggaggatatttgtatgagactaagttgaaagggaggcaagggctaattgtataaaatattacaggccatggttagaagtttggactttgctcaaagtttgaagggaaactcctagaagattttaagcagagaaaaaaagtctggcttgtttttagaaaattgattataagggggtcaggagtgcagtgagatcagaagagaaatgatagtggcttagataagggtggtgataaagaaatacgtaattgggatatagttaggaaatcagtaggtcctactaatgggtagagtgtcgagagagagagaaaactggctaggaggaaatacgatttaccaaaatgaagaaggcttgggagaagggggagatgaagagctctgttttttttgaggggggtggggtttgagacagaggctcactcttatcacccaggcgggaatgcagtggcgcgatctcggctcactgcaacccttgccttctgggttcaagcgattctcccacctcagcctcccaagtatctgggactacaggtgcctgtcaccatgcctggcttgctttttgtatttttagtagagatggtgtttccctatgttgaccacgctgacctcaagtgatgcacccgcctgggcctcccaaagtgctgggattataggctcgagccactgtgccagccaagagttttattttgtactttaaaattgaactgtcttttagacaatcgtagagaggtcaagtagtcatttggttactcagctaattccaggcacagctggagatagacataaggtagattatagcatatagctgctgcctaaagccagggcatttgatttgagaatagaaaggggccttgcaactgtgatgtgggaccaggtgattcagcatttgtaagttgtacaaaagcggagccagggttgaccaagaaggactgcaaggagttagttatgttgatggctgctatgaggtcaagtagtcataaaatacaattttctattaattattttttcagtccctgttgttaaatatttgtgtttattctggtttcttttccactattacaaacacttattgaatgattgaaggtaatctgtttacttttgtttctctagaaacaatttttagacataaaatttttagttcaaaggtcataaacatttttaaagctttttagacaagctgattgtccttcagagaaactaaccagtttatattcccatcaacattgatagtatcagactggtaagcagtactattaatttcatttaacaacattgatcagggcagatggagacatgtgcaacaaatggaataggaagacaggacttctttctgagatggcattcattacattctaatttaaaatggaagttttaacaattagaagtgaaaagtaattgttttcttttcatctagatatggtaaactacaaaatacattgtcactgggctagtttcttatattgtactcatacttttctttgtaagacatgtaccacagagaattgcttccattgtgctcatatttcttccctcagcagaagtaattgcttttttttggaatgttttgagagaagagagatctttgagaaagcacctgtagaaactgctttctctgtatctgactttacagctgagaggaaaaagtcagctgatcgtgtccagattattccatgtaaaaacagaaacacgtagccttgttctgggcaattgcaacagttcctaaatggccttactatccttttgccgctgcttctaacctttcttttttttttttttttttttttttttttttttttttttttgtggagagatctgttaaattttttttttctttttttttttttcttttttttattatactctaagttatagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagttgacagtcccaccaacagtgtaaaagtgttcctatttctccgcatcctctccagcacctgttgtttcctgactttttaatgattgccattctaactggtgtgagatgatatctcatagtggttttgatttgcatttctctgatggtcagtgatgatgagcatttcttcatgtgttttttggctgcataaatgtcttcttttgagaagtgtctgttcatgtccttcgcccactttttgacctttcaactctcctactagagttgttagcacttctgaggccttggcacttgctaatacttctgcctggaatgctcttccttcacatacctacctgcatggcttgttttcttgaactcaactgtttggtcaaatgttaacttttgctgagtaaacctctgccttatcctttacctgcttagtgcttgcacgccacctttaacctatgtaatatttgtctgcctctccatgctaaaatacaagatccatgacatctgagatgttaatctcttttggtcactgtccaaaaatagtacatgcacattgtagacactcagtaaacattaatgaattaataaatgactggaatcttcaaccctcaactgtagttgagctctttagacgctctaagtgtgaaaacaactggcccataggataaagaccaggttcattgtcactcataaaaccttttacagcttggtctggcctcttaagccttgtgtcctacttgacattattgaaaaaggcacattgcccacattatgtcctttacctagaatgaccttctcctctttctctgtcagtttctcctgtttttcaggagccagcccaaatgttattgcatgtgtttacaggcagaattccttcctctcttcactgttcctgagatactggattcatgccttcattatagcacttatgacaaaggatcataattatttgtatctcccccctagaatagtatctcatagtacctacagccaagaagcacttaagatactggataaaaagaatttgagggataaggcataaatacatcagttttaccaagtgttttgtgaatttatttcctgttacttataaatatatgtatatatttaccttccataaaagaatatacttataaattttaagaatatagattttttatatagatatttatctcagagcttgaaaccattgcctcaagtgaattggtttaaattttcttagttaatgcttgctttcatcttaggcctaaagtattgcctttttgcttttatacttttattttagcattaatagtacaataaatatttgtcaacatgtcttttaaaaactaataggtatgcttgtagtaatatttatttgatatgtacagttactttataagggttaaaaaaaaagcctaaatgatctatccttatgcttagggagtgcagccttcagttaggaaattgattgtttttacttttttgtgtctgatttgatggaagaattatgtaagttacatgctatctgctcagaaactgttatacaataaaatatttaatacttgagcgaaatagaagtcaccttgagtctgtgaaatgtttaaaaagtcttgaatttaaaagaattacattttttaaagtgatttttcttaaatgtctaagatattaggaaatatcaatggtattttagttggctaaagtggctagtgacactcatttaataggttttccatttgaccttttaagcgctactagcatatctagagttacctaaatcacaacacttatcttgtcaccttgtgtaaaatctaaattgttccttctcactttacctgtgtagccctgatttaagtgatttcatttcatgaggaaatgaaataataaatactaatttagcatttcaaaaagtgtctgaggccagtaaagagtagaactaataatctgattttaattatttatgatgtctcatttcacttcagatcttgactttttttgtaggactgtagaacttctttgttaattatgcccaggcagcattacacccagtcacctgagttagacttcttgactctctttatgtcatcactagtgagtcaaaaatgtattctcctccttagagtcatcaatttgacttcactttcttctttctagtagcatgaccttaattcatattcttaccttttgcttagactacctgtcgtaataggcatgaagtgcatttttactaagccgtgtcctacccaaactccttagtcttcaagtggcttcactgctggatctggtgtgctttccccctctagctactctccatctaggtacattcacttcacattattcaacattttccatatctactgttactttttcacgtattagctgtttgtacaagttgtcttgtctatccaagaggtaaaatactttcactcttttctgcctggctgaaatatttcttcagaaatatttgttgttgcctccagtatgctcctacagctccttagagcacctagtgggtgctttttaaaaatatttatttattcagtaagtaatgtctcctgtgagccactgtattttgtgataaataagaatacctgcagttaaaaaagtgttatctaccagacagcacggagcttatagtgattatttatatacgtatctgactcctgcatagtatttgactctctgaagacagggacagttgtgttgttgttgttgtttttttttttttttaaatcgcctgtcttgacacatacattattttaaatgagcttaagtctgagaggggaccttgaacatctagtttggcaccctcattttatagatatgtattggtgggggggactgaactgagaaaaggtttaggatttgcttaaatggatttagtagaataagaaggattagaaccttgagattacttgatatcgatgatttatggactcaacctcagaaagttaaccatgattcatattattttgtagctcacacatgcttctcaaggaagtttaagaagagacacttgactgaagtgatttgttaagaaagttagggggtgatgttaaccctcaagacatttcagaatgtctaaaggtatttttagttgtcgaggtggtgtagggaggaggtgttactggcatctagtgggtagaggccaggatgatgccaaatatcctacaatgcacaggatgtcaataatgtgaaggttgagaaaccctgagttagaaaataatagggaattgggtacaaggtgagtatgcttgtaagagtatttgaaattaactgaatgaaaacagaaagattggcaaaatggaaactagcatgaatagttctccttaaggtacagaaaagtacagaaagaaagtgctgaaaagtactggatcagccagttcttttactggccatcatctgctttcgtgggtcaaaattgccaaacctctcaatacgtatgaataaagtaggagtttggcttttcttatgaatggatatttctaaacagacatctgaaaattgaggagcatctacggcaagaaaattaaaaattaacattttgtattatatggattgattttctttttttaaacaataggtaagtttatattctaaccaactaggatttttctcaggagcacatggatgaagtatgctcctcgcagcttctaacttcagtaaggcgcatggttttgacccttacccagcaaaatgatgagagcaaagagtttgtaaagttctttcataaacaacttggaagtatattacaggtaagagtttatacttgtatgatttaccaatatgtactgtgtggtaaggttttttttcggggggtgggtgaggcattttcttgcattacacaatttattctggtggacatccaatctagcgtccatttgggatgatgttgtaatactttttagttgtcacttggttaaaataatattgtattattaggtcctgtttgtatcttcatttaatttggtcatctctaaggcatgtctcttataagcttttactggtttggtttatcttctcactgaaaacattttgagtttgaaatgtttacaaagtattctgtggctgtttctaaaataattggctaaagtaatttgactaatcagggaaattttggaagccagagaccagctggttgtagagactttttagggtgtaccagtacgcttaaattatagtaagtcagtaactgggagagaatttgccttctaggagacatttagcagtgtctgcagccattttgtttatcacagcaagtagtgtggagaaggtaggagggctgagaggaggacaggtactggcaactaatgggtagagaccaggaagaatcttgataaacatttgacaatacacaggacagtaccccatagcaaagtattatctggccctaaatgtcaacagtgccaaggttgagaaatcccatgttagtgttaataaaattaccttgtttattccatatgacaaacatctttacctttatatttacctgaatgtttttccattgagatagttcagtgatgtgtatttttactccacattaggtgatacatttttcttctcatctttattacagaattttcttatgaaacttggctttgcttcttatttctgtgtttaaactggttttagataatcactattaactttttttaaaccttgggcttgatgcaaatttgtatcactgtaattttccattttgttagtattaggactaaaggacaaattgtcctggccccgttagcagttattagtactaacagataatttctaaggactacaaaacattgatggtgttgtgcattgtaggaaactccattttagaataaggctgaaagagaaattataatttaaatattttttatcaagatccatgtagcccttcctcagttttgccttctatgataattgtggacagatcccaaagcattaatttctaaagacttttttctcagtctaaggtttgactgcttttctttcatcccgttcttgattttttcacaagaggacatacatgaagaatacaagttaatttacgttaaatattgcccagagtattgaaaaatttttatgagctagagcttaaattaccatcttctacatttttccttctgaaacccgttcaagaattgttttttccacaaagcacccagcatatgtacgtttttaccataactgtactagataagatagtcttttggtgggggagaggagcaggcattgaacatcatagttgtttgcctgtttgctaaatagggtagtccatattttagaaggaaaaagaggagtggttttactaaaaatgtatacagtatacttccttatttgaagattctcaacctaaaataatcaaaagggtcagaatctactttaaagagagtttattcaagcacagtgttggagggatagctgcctgggaagcacagattccaaagaatagacatcagaagtttgggatcatttatatcaggggtccccaacccccaggctggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggtgagttgtataattatttcactatatgttacagtgtaataaagggcacagtcagtcaatgtaatgtgcttgaatcattccgaaaccttcccccaagctatggttgggggaaaagttgtcttctgtgaaaccaggtcctggtgccagaaaggttggggactgctaatttatgtggacagagtttagagaagcttaacagagtttcagcatctttctatataaggctttaatgcatagttacaacagtctaattagttgaggtgatgtttttgtttcagaaaaggtggaagatgagtcttttctgccccctgatctgacttaggtacaggacagtaaaggaggcagttaatctgtaacaaacatcagtggttgggaggcaggaggtctggtctcttgatctttcctagtcatttacagaacaagaacagtgaggaaaagagttaatgtgttgtctaagaagaagaaatcaccaacgttcaagttgccagggcttaacttcctccttgacataataaatgtagagggtcttgaaatcctattttcttttacatgatcctatatatcaacttgaatagaactaatgtttacttttgaagaaaaatttaaattagaatggttgtcttaagtaaaggaggaagctttaaacatgatcctatatatcaacttgaatagaactaatgtttacttttgaagaaaaatttaaattagaatggttgtcttaagtaaaggtggaagctttaaaagtattctaatggtacatttagaggtggaagattttgtcttttcctttcatagcacttagtatttattactgtagtatatattgtatctcctgtactgtcagggaactttctggtattagaaatccctgtctgaattcatttgtgcccagcagttacatcaaatagggactaaatatagatgaccatatatgttcttcccttgtgtatactctttaagcaggactagcaacattcccacttagtaatatagcagtattctttagtaatactaacaacctatctttccttagtaatcataaacattagttttaagtttttcagtacttaaaagtaatagtattttataattgaagtttactgtctttaaaaattatttggtttatctttgaataggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggtaaataacgttcattttgatttttaggataattgacacataaatacagttcttgatcattattattaactgaaatcacattttacctcagcaaaagtagttgtttttagtaataccagttaatcacattataagtcattacatatgctagtcacttgtggaatttgaggactaacagcagttgctaaagatcaggaatgcgggcaggaattgatgttaaatgtacattgtcagataaccagttcacattattgtcctgtattcaggtcttgaaagatgagagaaggactgggatctgatcctgggccagtgccaggtgcctgccatgtctgttattgatccctgtagattcttcgagaatatgcattacccagaggtcactcccagtcaacacaaatgcttattagttagggctttggttttacctccctgtagtttgttctgccttgtcaaattaattttgatcacaggtgagattggatgactgttctgcctcaagttgaggcataccaggaagccttttccctagatgtgtacccttttcctgaccctcttttatgagaaggaaacaagccaagacccaaacagagatggctcttctttcttagaatctaaagtagacgaagtcaggctgtccatttcacacttttcatgatatttattttctggatataaataaatttcagacgttgctaagagcttgatgaaaataaaacagcatgatactataataaatgattagaaagtaatacaggccaggcttaggtctataatcccagtactttgggaggctgagacatgagaaatgctaaattatgtatctaagtatgttgctaaattctgtgtaattgatttgttttaaaggctaaaaggattcttgaagatcatggctcacctgctggagagattgatgatgaagacaaagtatgtgctaattaatttttgcctaaaaatatggctgggcgcggtggctcacccccgtaatcgcagccctttgggaggccaaggcgggtggatcacgaggtcaagatttccagaccagcctggccaacatggtgaaaccccgtccatactaaaaatacaaaaattagccaggcgtgtgcctatagtcccagctattcaggaggctgagacaggagaattgctagaacctgggaggcagaggtggtattgagccgagatcatgccactgcattccagcctgggcaacagagctagactgtgcctcaaaaaaataaaaagcctacaaataatgcttttgaaacaatataaaattattttaacagctttcaccttaatgtttgaaagcagactgtatcatcaaatgacctttttcctgacacttttttattttaaaaataaaactagactatcaaaaatggttctttgtattttttattagataatgatcattattaatacgatagacttactatataccttttacacatgtactttaaggaattaattactcaaatatttttgtgtctaggacaaggatgaaactgaaacagttaagcagactcaaacatctgaggtgtatgatggtcccaaaaatgtaagatctgatatttctgatcaagaggaagatgaagaaagtgaaggatgtccagtgtctattagtaagtttaaaggctctgtactatctttatactttagttttttgtaggtcatttattggaacagtttggtggagtgtaacaagtataaaattaagtgtcaaagaactctgattttgaatttcactgtgaccctgactaaattatctagactttctgcactgtaagtttttaatacattctgtttgaggatttcagatactgtatataaagcatctgtgccatgcaggaatgcagtaagtggtagctattgttaagattatgtgctgaaatttactaaaaattgtgtattaatcaacttagatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtattcccgtattgactgacacacttccatcagccttattttaactaatcaaacttccatcagccttattttaactaatcaaagtagatccttctaaatattcaggtttcatgaatgcaagcctcattaatatgcttattaaaatctgaaaaaccagtttattttttatgattgttttttagagacagggtcttgctcagtcttctgggctggagtgcagtggtgtaattgtagctcattgctcatagcctcaaactcctgagctcaagcgatcctcccacctcagcctcccaaagttctgggattacagacatgagccaccacacccatccaataatttatacgttttaaattatacactgtttttagtggtgtgattaaatttcacaccggccctctccttcctatttgggttgtgaatcattccattgtccggcatgtctacactgtatacactacctgcttgttaatcacttaatagccatctagggtagcagatagacttgcagtataacagtgttcaaacaacccttatttgacttaatggccccaaagcacaagagaattaattattctattattagttattgttaatctctcactgtgctccatttataaattaaactttatcatagataagtgtgtaggggaaaaacagtataaatggggtttggtgctatccacagttttggaacatacactctatggatgaggcggtgcttttttatatgttattttcctccctggtctagatcttttcttctggagttggatattttactgtgatgtgccttgttggggtcttttttcattatttgcagtggatactcagtgattgttttcaagttggtaaatttttaaattctctttattactgccacaccattttctcttttctctccttctgtaattatcagatattattagtactcatggattgatcttctgattttctcctcttttccttatcttttggttttactttgagagattttctttgactttaacacttgtatgaaattatttttatttcagctgtcatatttttaacttctgaacactttctttttttctgattgttactttttaatagtgccctgttatttcacagaagcattaccttccgttttcaaatgtctgctgaaccttggttctttatattgaacagtgatatatcaaaaagcaagttaaggttcttttgggcttcactgcaggtagggcatttggggagacagccagcatattcctacaaacttctaaatgttagtatctattggtcttttctttgagatggtttagattcttcaaattagggtccttcactgtcgtcctgcctggagtgtatgagcttggctgctgatattctgaagctagattgggaatggggctgaggtcccaccgttatacaggcatgcactagattattctgttttcagtattctatttaggttggtgcaaaagtaattgtggttttggtcattttcaatagcaaaacccacaattacttctacaccagtctgatactttactgtgtcatttgtgtctccacctctactcccagtggccccaggtttggggctcactagtttaatttctctaaaatataatctgccattttctgttgaggtgggaggagagaacctacgtaggcacattttccttaaacagttttaaacaactaccaccaccgtttcatctccagctcctgccccaacatcatcatgtcttcctttctagatctgttacttacagttatgaggtgaatctcagtttttgtttcctctccctgctgaaggcatttagctttgttcatcttcctctcgtcacttcctccttcattcccttcttgtctgcattaagtgtcttttagagtctgaaaaaaaatgaacagtgcagtctgttcgttccagttgtattatactgtgtgtgtgtgtttttaaggcaacaaggaaaccctttaacttagccatcttgaaatcacaaccaaagccgcctccttgaaatagttttagaagatacttttaaatttctttgtatgaaggtcttgggttggacaaaaactacacactagtaatcatctcttttatagtgaccatatatttcaggccctgctattaaaacatttttcccttctaggtcctacaacgtgactttaaaaagacagcagaaagcaaaaatgtcccattggaacgagaagccactagtaaaagtaagaaatctaaataagtctttgattttaagataatttcctttatttgctttaaagctaaaaaaaaaaaaaaaacacacacagaaaacactaaaattcttagtttgaaagtactttggacctgatgtatgtttttcttctccctataaatcctttgtagaaaacataagaatttgtttctataaacaataaagaaaaggtgacaaatatttacctgcacagacaaaaattctgtcaagagcatcgcatctttagatacaaataatggtagatttaaaaaaaaaatctatttgtaggccttattactgaaagtcctaattttttagaaatcaggtggatttcaggaatctgagtcttaaaatgctcccaggtgattttgatcaactaaatttgggaaccattgataaggaaaatttgtagttgccttttctttttggtcttaaatatcttgattgctcttattcaggcgtattgtctttattagtataatagtaaaatttaacattttttgcattacactaatgttaagactttcttttgatgacagatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgtatgtatcatttacatttccaaatatttttacttttcatttctgtgcatatttcttcattttcagattagcattctccacatgtaaaccattttgtgtttaggtttagaacatgttggaacatttttctaattcacactttaactttagcagaagggtaatagtgaattaagatgaccatctcaaaacccacatgctgttttataattttgagaaccaaagggataaaaagatttcatcttaagttcggctctgaagtggtaatgatgcatgaatcctcctttatcctttatactacctattcttctcaactgtttagaatatattgcaaattttcaataaacttaaaggtttacacttgggataggaaataaaacagtttgacaacagaatctttatacagtgaatgataaaaaaaaaaaaaactaggaaatctgtactcatgatagtacttactaaatgaaaattcaagtgaagcccaggtctgaaaaatacttgagcagaggaaagcaaaaacctttaaagtaattaatcttgcttaagctgcaaacataaatgaaacttcacttgggtcatttctgataaatgcttctgttagaaccaaagcttaaccccagcctgtcataagtagccccctaacatatggatatgtgactagggactttctgagaaggtacttgataaaagacaattttgtaattgcaaaccaagcaaataatttattttacttccacattttccaaataaatacttgcctctgatattttgtcagtggaacactaaatctcttttggtctggtgttcccacttcctgaattgcttcttactcaaataaactgtaaaattttattgtgtctcagatttgtcttttacagtttggtgtcagagtaggatttgaaagagaccccctgtggcctctggaagcatcgaggaaccaggcaaaaggtgtccattgtgctcactgctttctcgctgcatctggaggtcctgggtaagtccctctcggatttcaggctccacagtttgtgtcctgagctctctgagtttatctgagtaattttattttgagactgagtctcgctctgtcatccaggctggagtgcagtggcgcgatctcggctcactgcaacctctgcctcctgggttcaggtgattctcctgcctcagcctcccgagtagctgggattacagacgtgtgtcaccacacccggctaattttttgtatttttagtagagacagggtttcaccgtgttagccagaatgatctcgatctcctgacattgtaatccgcctgcctcagcctcccaaagtgctgggattacaggcgtgagccaccgcacccagctgggtaattttattttttactggatccagaggtcgaactagatgtttgacagtaactagactgggtccagttggcagcctcaggtaggtgaggtttagaaagatagggtattatgggttcattaacacctaaagactctgggacccctctttctagaactctagcaaattttatgtttagaaattaggaacatgaaactatgcctttaactatgcctttctggagaaatggttacactttaccagagaagagaagagttaaagttacagtggagaagttttaatctagataaaattgtttatggggacattagaaaagaagggatcctaaatgccttagaaacaatgggaagcagtttttgattgttgtatacaggcttctaaaagacataattccaaaattgccttgctaaaagattccttgctaaaggcaaataagacagatgaaaagcttaagcagtgaattgacaaccaaaataaaatgaattgtatgtagggagtgatttcactctgacctgttactctgcttatcctcctctaattattctgagtccactaacccatttgttcagtcatcttaatccttttgcacaattaccctttcactctggacgatgtgacagaaaggaagttaggctaatgctttgcttagttagaccctcagccaggacaccgaggtctggctcctgtaagtacttttacttctgggtcaaaagctgaactcagagccatagcaaaagattttccaaatcccaaggaaaatccaaaacagtttgctgaggaatgtagatttagaatgaccctgggcttcctgatttctgtcagtttctacgcatgatattagccactggggaagcatgttaatggatgactacggcaggatggcataagcctcagaagagtattgccaaccctttaagagctacttctgtggatagcccaaaagatgctacaaaaacaactggaaaacatctagaagctatccccatggtctttccacaaaagattgactagtccaaaaagttgaatctatttctgattacacggctaaattggaaatctcatttgttaaacattctggtcttaaaatacagcagggagtatttcctgcgggaactgaaatggtttttatggttttattcattaatagtctctgactagagtctggtgacttgattaaaaaacacaagattggatggcaagtcactgatatggctatattagtcaccatagctgaacattttgagagaacattagaactagaaaaaaatcagtttctgtaaagaggccattgaagaaaagagtctccacgcttgaccagtcctctaatggacctacctgtgttgggccagactatttcctcattagatgaagttcccaaggctgggccaggcatggtggttcatgcctgtaatcccagccctttgggaggccaaggcaggcagatcacctgaggtcgggagttcaagaccagcctgaccagcatgaataaaccctgtctctattaaaaatacaaaattagccaggcgtggtgacacatgcctgtaaacccagctacacaggaggctgaggcaggagaatcgtttgaacccagtgggtggaggttgtcgtgagccaaaatggtgccattgcactccagcctgggcaacaagagcaaaactccatctcaaaaaaaaaaagttcccaagggtttgactctgaagacaataatcaacaccaatgggacatcaagggattctctggtatgttactctccataaggcccttaaacaaacatggggaggaaactaagatcagcatcagtgggagtcacgtacagtgttggtggataccttatccactttcaaccccatgctaataaatcagccagtcccttggaggaaagaaaatatttcacgtttccaatcaagttcagagaatcctctgtgaaccagtctaaatgacagttggactaatctcagaaaagcatgccttcctacaatatgacactaaattgagagggcacttaaagttctctctggaaggaaagttaattttagagcttcctgacccttctaaacctgaactgctctgtttcctacaagcaggaattgatcatattgaaactcactcttataccaacctagacctttctgaagtacccagatgtttgtgggcttgtttctcaactgacaaagggaagattaaaagtggtaagcctataaaaatacaaatacattattccaagccattgcctaaattgccctcatgccccctagggtcagaggcaatccaagggctttacccagttatagaggatttaataaaacaattccttgtacttgtctctataatactataatcctacagttaagaaatccatcacacctttaatcccagcactttgggaggccgaggcgggcggatcaggaggtcaagagattgagaccatcctggccaatatggtgaaaccccatctctactgaaaatataaaaattagctgggagtgctgatgtacacctgtagtcctagctactcaggagactgaggcaggagaatcgcttgaacccgggaggtggaggttgcagtgagctgagatcgtgccactgcactccagcctggccacagagccagattccgtctcaaaaaaaaaaaaatatgtatatatatatatgtgtgtgtgtgtgtatatatatatatatatatatatatatacacacacatatacatacacatatatatatataaatatataacatataatatataacaaagttggagatttgttcaagacttaaacatacaataaattgtcaatccaagatttcctgctattccaaatcctaacactttgttatctaatgtgcctacagattctaaatggttcacagtgtaatctttctttcctctgcctttttcagtattccagtaagccagtagttctctgcttatacctggaagaaccagcaatatacttggactgtagtgccacaggggttcgctgaagctctatcttgtttttctcagacattataccaagacctgtcaaccttacaattccatagaaattgtattctgtctatatgtagataatctttcatacttttagcttacaatggacataaggcctcaatggcaaaactttagttctgtagagcggctgtcctcagcctttttggcaccagggactggtttcatggaagacaatttttccatggactggggtaagggggatggtttcaggatgattgaaatgcattacatttttgtatattttatttctattattattacgttatataatgaaattggtatacaactcaccacaatgcagaatcagtgggagacctgagcttgtcttcctgaaactagatggtcatatctggggatgatgagagataatgacacagcatcaggcattagagtctcataaggagcacgcaacctagatctctggcatgagcagttcacaatagggttcaagctcctacaagaatctgttgccgccagtgatctgacaggaggcagagctcaggtgagaatgtgagtgatgggagtaggtttaaataaaggtgaagcttggctcgctggctccccccaccactcacctcctgctatttggcctggttcttaacaggccctggactggtactgggggttgcagatccctgctgtagagtaaaggtccattacataggatgtgatctgactgcagagagaattttcctcttaactgaaataataaaaacaatccaagggttccctaggcccacaactaaggcagttaagggagttcattggtcttatgggatactgcagatcttgagtcccacatttctctgctggcttcccccttgcctgaatttagaaaaatctctgtcccagagctttgccatgggaagataattaggaacaagctttcaataaaataaacctggccttataaccccttcaggttcaggatacccaagttatttaaaacctttcactttgggattatcaaatatgataatccatccttaggagtccttactcagaaacgtggaggaagctactgacccattgcttattatacgttacagttaaatcgagttgtcagagcatatccaaaccatctaaaagcagtgacagcagcagctaaattgataggaactttatctgacctagtattagggaataaatgttacctacaagttacacgtgcagttgaaagctcattaccttccagtcagatccaacatgtcttaataagtagactaacattttatgatatccttctcctgtcaccttctaatctctatctcagatgtcagtctgcttaaccctaccactttgctgcctctgtctgaacaataggaagaccaaaactgtgtgtgtggtatcataactattgactcctcacattgacttatggaaaacttcattaaataattctgaataaatacattttattgatggatcctatgaaaaaactgtagagaagaaatactgagcaagacatgctgtaacaactcagtatgaactaatagaaaagggaattctttctcagtttaagtcaggacaacccgaagaattacgtgatctaagacttaaccatatagcaaaatgccaatcattttccatttatacagataataggtatgcctttggagtgagtgatgattttggaatgttgtggaaacaaagggtttctcacttgtagtggaacccccatcagtactggacctctgccagatgagcttctttcagctattctgctgccctcacaagtagctcttaataaaaatgatgctcatgctcgtaggactgaacctgagtatcaaggaaatgcatgtgtggacttttatggccaagtctgaaattgacaaaatatgcattttgaatgaactccacagaattgaccaagatcaaatcactcaggataatttgttcagtaaacaatgctgtgcacttgagttgaaacaacaaaaatggaatcttaaaggttgcaaatttcatgctcaacaaggactcagtgaaggcccagacagccagctggtccttcctgagtccttcaaactgtcattattattaaaggccctgcactctacaaaccatcatggtgaagaaaaacgtttcagattatgaaaaagattatgaaagcagaaatggcttacagcagtgtggcttgtcaaactcataaagctggaaagacccttaagatttctgccacctgctagaccatatgtaggtctgcagatggatttcattcagttgccaccctcattgaggtatcagtacattcttgcggtagtgtacctgtttgcaagatagattgggacttacccttatagaaaggctgatgccacaacagtagcaaaaaattcttaggaaatgtatttcctttatggggcttttctggagagatctccagtaataagggaactcattttcctgaacaggttatcagataaacaggattttcaaactcggtggcactaccattggccttgtcatcctcggtcttctggaaagcttgaatggacaaattgtatcttgaaactaaaattagctaaattgtcagctggattaccttggccaaaaattttaccactagccctaatggcaattacatcaacccctacagaaaaacacaaatttgaccccttatgaaataactggaagacctatgcctttaataccagaaccccatgtatcacctgtatttgttagctctgaaatgactcaatactctaagaccttaatggattatgcaaaagtctatttctaccagctgaaggaggctttttgtgaactgcctaccagtgatgatctatgactggcttccataacttagaacgtggagattggatcttttggaaacaacagcagagaaaaattgcccttgagcctcattggaaaggactgtagcagacagctcttactactcacaatgcagcaaaacttcagggttttcagccttgggtccatctatctcaagtagagagagcttccttagactcttggacttgacaacctataggtgacttaaagatataaaagggaaagcctttccctaggagcaggtggcatcgtgaagtaaacaacttaccaccacaatgaaacgactacatttaaaacttttctcattaagttttgatttggttttgcattaacacaaaatgttcaaacttttgttgggaacttttcctactcaaacagaatatcctctaaggtctgatgttcaaagaatagccactctcactcaaccaaagcaattgctggccatgtagtcatatagatgaatggaatcacaactaataccgaaatctactcccacacacacttgggtgagcaattggttttatgaaaaggtttggtatccttcccctagcaggttggttgatatttatggttgactgacttcgcactgggaagaagttacagaagcaaaggtatgtcctgtaactactattgattttattgctggtaattttatcactatggacagaaaaccttaatggaactgggcctaatctagccagggttccagtctccctatatgcagtcagactttatgatttaacaccaattagggagactgctctcctatataatgacacatatttaaaatcagaacttcaccatgatacccttgactatattagtagagaacggactgaaactgacattggttcaaaggaaactctagaggcaaatggaatacccctgtagtttcactgtatacaatagggtttttaagatcagtattcagggcatatttgaaaaggaaacaagtcatccttatttggcgatggtacccatgtgtaatacatagaagtgtttttttattcctctttctatttaaatcataaccattctacctggcagtgtgcagatgcagatatgacagagaataaccatgacaatcacatcattcccaattggtgggtaataggatctcctttgcccctttctctcagtaatactggattattcatcttgtatggcaacaaaatatataaatgttttcacctatatggtctggacactgtggtttgggctatttcctacctaaaatgaccagatatgactctttaaatggttgtgaaattcttaatctggggttgtttgtacatgaagtgatcccttacaaaagaactccctgtgatctcccaaactcgaatatatgaaggggttctagattttgttctttggtaagatcgctttttctttagctggcagtctctgaattggaaaaatggcttatggatatttcagcaacccttgaaaaaaagttttaatgatactttcgatactcttcaagcaatacaatctgagatgagtcatttggtctcactggaactccagtagaagtttagctgctcacagggatgagctttgggtgaaacgtattgtttttatgttaattagatattgttgccccaaatttaaaagatcttaataaatcagaattttttttatcagataagcaaggcctcctccattgatttattcagttggttaaattttaggcccctgggaatctttgcttagagggatctttaagttcttgctacagttactgtgttttcttcctttgtgctttatatccccacaaggggttcaaatgctttccagcagccactcacacgtcagatgattgccatcagggaagctaacactgtgtaaacttgatggagggtgcatgactgaatcccaacataacttttgatgataacaactttacctgacttttcatcccaacttctgtgtcagtagtggttacaggataatgctactccatttggccaccctcaagctgagagggcagccaaaaggggggaattgttaaagcaaaattaaaatggagatcaggcctgaaaatacctgaccaaaacccccataaaacaaaggcctttaaaacagccttaatcttccttgaattgcaaacataagtgaaacttaacttgggtcatttccaatcaatgcttttgttggatagaactaaaaggagtttgagagcaacctgggcaacatagtaagaccctgtctctacaaaaaattaaaaattagccaggcgtgagagtgcaggcctgtggtcctagctactcaggaggctgaggcgggaggatcacttgagcccaggagttctagactatggtgaactatgattgcccctgctgcattccagtctgggcaacagagtgaggccctgtgtcttaaaatttcttcttaaatatatatttacagttatgattcataatttcttagaaagggggcttataatctttgaaaaacgttagtacaaagagtaactcttctaactcttttgtttgcctcactacgagtacaattatacatttaaaacttcgaaaattactggttagatttattcttatctgatcattgtctagttgccatagaagacatttaattgaaattaagtcaaaggtagattataaaagctcttgaatttgaattttagtcagggatcctactgaatgtttttgtgcaaggaagtgaaatggtcaaatttatgggctgtgaagattaatctgctgactatagcatatactatcaagctagattgggggatctactattatataagtatgaaatataagctgaacaggagcagggtgagaaacagtgcaagaagaagaaaaacctaagatttctacttggataattggtagaattatgatactattaaaaatcagaagggagaactaggagggaaaaaaatagaattcaagtttaggaaaaacagtttaaggtgatcacaaaagacagttactaaattcatacctcagctttctaacagccccatcagagttgatacactgaaaagtttgtaagtggttacttacattctgctgggtacagctctcgtgttcagtaaacatatgaaaaaacaagagttgtctttctgtttttagtcctggttgtaactatttcttcagcatgtatgaactgcccccctgcctttttttttttttttttttgtgacaaaatggtaacagcttgacagtatgtttcacagctgtgattgtagcttttcctatgaactgcatatttctaaattattcatagagctgaatgtagaagaaaacgaaatgtgatagaattactgagaaaataattcactatttctttacatggatgactggtttggatctagagtatgtatttttttttttcattacattacaggaagcagaatctggtaatataagtcaaaagtctgatgaagaagattttgtaaaagttgaagatttaccactgaaactgacaatatattcagaggtatttagctgtctttaattaaacttgtctttacataacaaatactgttaaaatgaaaaatgatttgtatttttaattttcattccaaaggcagatctaagaaagaaaatggtagaagaagaacagaaaaaccatttatctggtgaaatatgtgaaatgcagaccgaagaattagctggaaattctgagacactaaaagaacctggtaagagttatcaatttaaatcttgccatattgaaaaatcattgaatcttcatactactattgtgttttattttttaaatatgctactactgacctgggagatttaagccaaatactagaaagaaagtgtaattctgtaagaattttagttcaactatttataaaacagtgtcagataatttttttctattcacatctttagttttaaaaaatgtagacatgctggctgggcgcggtggctcacgcctgtaatcccagcactttgggaggccaaggcgggtggatcacgaggtcaggagatggagaccatcctggctaacatggtgaaaccccgtctctactaaaaatacaaaaaatcagccaagcgcggtggcgggcgcctgtagtgccagctactcgggaggctgaggcaggagaatggcgtgaacccaggaggtggggcttgcggtgagctgagatagcgccactgcactccggcctgggtgaaagagcgagactccctctctgaaacaaaaaaaaaaaaaaaaaaaaaaaaaaaaaaaatgtagacatgcccatggtttaagaaaggtacaaaaatattataaatagcaaaaacccacttttttttttttttttgagacagagtctctgccaccgaggctggagtgcagtggtgtgatctcagctcactgcaagctcctccgcctcccaggttcgcgccattcttctgcctcagcctcccaagtagctgggactacaggcgcccgccaccacgcctggctgatttttttgtattttttaagtagagacggggtttcaccaagttactcagatggtctcgatctcctgacctcgtgatccgcctgcctcagcctcccaaagtgctgagattacaggcgtgaaccaccatgcccagcccaaaaacccactttttattattgatttttagttctttaggagactataactctaaatattatgattcttagtttttaagatgcagataatacctcttttctacccgatgacaagtatgtatctagccctacctctctctcctcctcctctcagtgttcatattatttttgtttgttctattttttactttcaattttggttaagtatatgtgcattttgttccatcaactttggtcattatcccttgctgctcctcctctgctttcttcctggttctctgttcagttttacccatattcttacattactaaggctattatatacgcttacattttgttttcgtaatataattaaatggttctataccttctctgaggttgcttctatataaatatcattcattgtagagccaagcgatagtctcagattttctgtatgagtctaataacacagctctggagccactcaatgtttcttgcatcaggatcaaagggttttctttttgttgttctccatcagttcatcagttgatgaaaattgcatgatatctcattgtttttgtttttcctggaaatggagttgaggagaaggaaagacccttcagatatcagaccttcagttaatttctgttttcagcccacttctacctgttagaatatggtacccttctcagttgcagcctcttgcaagtgtttgaactgcagcttcctccactgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacgcctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtatacaa

SEQ ID NO: 2551 - DNA, 157125 bp, Homo sapiens
atgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaacaacacaagatttaccatgcctaggggatgaatggcaaacccaactttggctaatgtcattgagaacaacttggaagcgtgagcagagatatctcatgaagtggcagtgaacctacatttccatttatcagaagcaaacatggaaggttacatacatgatgaagtattggaagttaaagacttaagacacaaaatcactaatttaaaagaacatgcaacatgagtatcaacttgctatgtagtgtacatgtaaatgacccaaatattcacctctagcatcctgaatctcttcttactacagctgttatttgtacagccactgaatgtagattagtaaatactgacatcacaatgttgacacatgcagggagggggagataaagcaacagttcttccttccaccttttccaaagtctcaggattaggggaggtaataagttttggaaagaaactgaaatgcaacctggaggagagttggacaagccacattttccactcatgggaaagaagcggaccattctgctactttcccaaagacaaagggactccttaaagggtaactgaaaaatgagcgctatcctcccagactgttttcttctatcaagtactgcatcatcggtaagcactgaatcctacctttcttaattatactagccaatgacttccttgttctcgttctttattctaagatttcccaaaatttgtaatatcaaatccaggctttagtttatttggaaagtggtttcagcacctggaagatgagctggctctggggctctggaaaatcatattcctttatccttgtcccagagaaaagtaggtaggaggtagaaggtttgcttttgtggctctggatggtggagaaaggtaaaaggaaaatgagaataatgggagggaagaagacaggttaaatctgcaagggtagatcaaaggtaaaaataaggtggaaaaacccattggtacttccctttttctttctttacacagttagttagttagtttgtttttttatagaaaaattagggttctacatttacacatagcctgagaaaatgaattacaggatagtgttaggctcacatgggtaagtaaaaaatctacagaaaaatctagtttcaactgacatggctgaacactgaaaaactgccaagaagttacccccaaaagatacagagaatgtatagacagggacaagtcaaagctcttcctgttataccctctccctaccctgttacagggctgagcagagttggtggtagatgatcataattcaagcaactattgctttttcttctatggctttggctgaaatgtatatgctgattgattgattattatttgattagtacatatccagatatattcagattttgacatttaatacacagcagaggaggctgcatcagacacatgacactctgtgacatccatttcattcacaccccccacccccacagtcagactgaaaactcacaagaaggtgtctgtggtgaagaacattacaaaggttataaatcttaatagggccctgagagtttttccccctatgcttaggtgaaaaaggcaatgaacaagatgctctcgttctttaagtgctttgtgcaacaacgtccgtgtcgatgccgaaatctttttttaaatctttttttggaggaatcttttggacggaggcaaaagtcttcctccagagttccagtctcagaagctgcgattccgccggtggtgacgctccagttaccctacggtgatcacacgtgtgctgatatacctcttgtgcccacgttcctccttggggtcagtcctgcagacctgcatcaaaatgctttcagagagtctgtggactttggggaggtgtcatctgggtgaaatgctggggctagggaaggagcccgaattccttggtgactgcaaagggatggcggaggatgtgggggatctcttggggctacacaggtccccattgtgcagtttccacagaagctcctcgttttccatagagagtcgcttgttgactttcgactccttctccagcgactcttgcagaacagcctgctccgtggaaagctgccttgaagaaaaaggccagaaaccatgagatctatgtaaaaaaaaaaaaaacttgaaaaatttttcttagcgtttgaaactttaaagtccaaaattattcctttgggataaaacagaatcctgcacaaggtcacaggtatttggctggctaagaaaacccaaacacaggccgggcgtggtggctcaagctcataatcctggcaccttgggaggccaaggtgggtggataacttgaggccaggagttcaagatcaacttgggcaacatggcgaaactctgtctctattaaaaatacaaaaattagtcacgcatggtgacatgtgcctgtagtcccagctactcaggaggctgaggtgggaggactgctcgagcctaggaggtggaggctgcagtaagctaagatcacaccactgtactccagcctgggcagaagagtgagacctcatctcaaaaaaatatataataataactgtactttttgggcaatttcatagtaggctgagagccacttttgcaaatattcgacatgttttatgactaccttatgttgcaggctgttttctatttggttttgtgttgctctttgtctgaaagcattctcagaggcagccagaggccgtgggagcaggcttgctggcctgggtctcagtgtacagttttcaggccgctttggtaaaagcatgaactactacaatcatattttccacagagaaatcaatgcccttttaaccatctgcttccatcatatttccaggaggtgcaggggtagagcgtgtccagaaagtacactggatgtccaagggagcggggagctcgggagaaacagcactgttttatttttaccttgagattgccatgtgcttgtccatccgagctttcaattcttcattctcctgctggaaacgcttcaatttgtcaaccaatgctgtgttgttgtccaccttggcataaacaagaattccaacatttatacaatattaaaaaaaaaacccctcatttcttaaggcacctcacgacacaagcacactttggagatttaattaaggaaaatgcaattccatattaaaatatttatacactaacaaacatactgaaaaagattttaaaacagcaaaacagagcggctgggtatttttaaaacatgtatgccaggacacttaaatattgatacgagtgggtaacagatttgttccaggtcatgttgttttggaattctctaagaattggtgcctctttctgtttcaatgtgaaataaaccctgcagacacactgcccacacttatcaaagcttatctatctccttacggtgaattttgctggaaaaaaaaaaaaaaagattcccacatctgatgaaaactcacaggccagcaattcacagtccctggcaacgtttactatggacttgaactcagtttcatggtaagttttcagcatttgcgtctgagtggccatacaaagcttcaattcgatagagctcttagagcatgccatcaaagaagtaacatgccacgagtctcctcaggtcagctgaagatagataggtctgttctcttgctgccctgtgcaggctgaactttcaaggcaaacaaactgatcagcggagagatgaaaggataagatgcctgaggacatttaatcacttaacatgatgaagacctgattccatcccccactcactttctaaaggtaaggctttatgaagaggcaatattatagctccgtcaggattaagtctaagtccttgtccttgtagcaggactaacgcgctttgagtatgttgcttagtttggaacctgattgttcttaagacatcctgttatccagaagcagctcaggacaacctgttcaggttaaatcactttccagaaaaggagtctacgttcagtaattatgaaggattcccagataaaacaacgtggaaaaaaacctggaatttgagattgggaggtattgtcctttaaatatctcatcctagggaaactagtcctaataatgtcacagagctgattatgggcagtgccggtttcatgggaaagctgtctttcttagaaaacttcctgtgcttctaagtctcttaatttcatcagaggcctgtaatttacaaatatgaagggaacagtgggtctccctctcattgtatcaactcattcttgcacacatacacaatgcaaggctgaaggatattatcaggatacctctggggcatggcaagaaacaaatagtagatcatcagaaattaaatgtgttggtaagtttacagcaaagtctgatttattgcacatgattttttgaaagttttgatgcatgaatggcatatggagcagtcctattaacaggatcatctgagtcatccctgactaccagattagaagataccagactcagtcgaacaggacgacctttggcaggaactggtatgtatactaggttggcccattaacaaccatgagttcctttccttcctttacaaaaatttcctgataattcaaaatgctggtatatccacacaggggcttggccgttatctccctcaacagaagtcatagtctccagaagaaaaccaaacgccaaaccaacacaaaccaagcagcagagaggtcccccatgtcccctactgtccagggctggtttgggtttgaatgaggcacttgtagaagcctgagtcactcatcactgtggggagaagaggccagtagcatgcggcagctggacagtcaacagcaaggcaccgcgagggcggggatcacttaagctgccttgccaaactctgccaacttggttagagtcctggctggcagcagctgtatttcagggccgggccaagactgacgctgaacactgaacatgccactcacactaacatcgttctctgttctagacactgcaaagtgaatgttaattcatatttttggtaacacctgctacttgtccaaatggattaatcttattatagcacaattttttttttgagatggagtcttgctatgtcgcccaggctggaatgcactggtgccatctcacctcaatggaacctccaccttcccagtacttgggattacaggcacccaccaccacacccggctaagttttatatttttagtagagacagggtttcaccatgttggccaggctggtctcgaactcctgacctcaagtgacccacccatctcaacctccctaaactgctggcattagaggaatgagccactgcgcccagcccacgattcttttatcacatgctaattcacaagaagcaagatgaagaattttgataaatagtattgctattcatttctattaaattcatttctattcatttctattaaacgtatccaactgttttggatctaagaaacctgtccagggtggctggtatattaaagtactgattttacatagatatttaaacatttttcttatgcaggtgaagatccaaaataccactgaaatataagcctgatttgtttgtagtttttccaaggactgggtgctgttttacatgttccttgaaaaagaaaacattctaggaggcagcaatgaataaatatggaacaaacttggaaagaaaatgtgaactttatcttttgtataatttctaaatatctttaggagcagttaacccaactccacagttctaaaatgcagggctcaatttcacacatattaccccatttgtaagatcctctttcattctgaaggaaacataccagtttctccattttcattaacttgatgtcctgttgatgcagtttctcattcttgatctctaacacagctttcaggctttctaactcctgttctagatacatgatctgaggatttttctggaaaggacacagcaagatactgctcttattccacatagttcaaattcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatttcacttatttatcagtaacttaatatgcaaaaatgtgagttgcatcaaacatgttattgtatcaagagaaaaactttgcttacatacaaaacagaatcttggctggagatgaggcaatctgtgagtcagttattggcattttctgggagaacagggaacaacagttctctcctaccaaacaaactgatcaggaaagaaaaagcagtgcattatacggctctctggaaaacaacagggataacaatgtcctgagtgtttggatttttgttatgatggggctacgttgactgggccatacttctagggcagacataatactatcattttctattgtgacaccccagtacctacacggcatggagtacacagcctatttaaatttctctccaaaaattacaagtttgccaggcatagtggcatatgcctacagtcccagctactcaggaggctgaggcgggaggatcaactgagccaggaggtcaaggctgcagtgaactgtgaatgcaccactgcattctaacctggtggcagaacaagatcctgtctcaaaaacacaaaactctccaaaataaatgctacatcaggggaggcgtcctctgagagcacaccatcagtgtggatttcccaccaccgcccacccactccttgctttattcggaaattcaactaaaccattcaaaatttatgctacagaagaacagcatatggtccactgatcagatatgtttaatgaagcaacgtcttaggtaagagtcggtggtgtggtcatcaagcttatcttccggggcattggtttctgctctggaccaatccttagggagaatccaggaaggggcctcggggattacttaatccaaaccccttacttcacacagaaagaggaaacgtgttccacgggttaagcgccctactcaggaaagatcaggaaagcttccagagctggaaagggtcagggcagggactaatacatctttaattctaggttctttagatagttccctgaggctaggagaggtatgcgtgtgtatggtgggaggtggggtggggtgggatgaggagaggttggttaatgcatacaaacatacagttagacagaaggaataggttctagtgttcaagaacatagtagggtgactatagttaataataatatattgcgtacttcaaaatagctacaagagaagatataaaatgttccaaacacaaagaaatgataatgatgacggataccctaaataccctgacttgggcattacacagtctatgattgtctcaacacatcacacgtaccccataagtacatgcaaatactaagtatcaatttttaaatttcatacattttatacagtgttacccttgtacgcaggatttttttttttttttttaccttgaaaatagcgaatcctacctcatttttgttagagggaaatggcataacttaccgtcagttttaaaattagagcatttacaagacttgtaccctctgcattttctcctcctcctctgccagcccatccctttctcccggactacagtcagacgcactctttttccgcagcctcagcatgcttacgtgacagaagcggttggatgcttctgtgttcctcactctgactctgccttagcttttcaaaagcggctgcagtagaagaatcccctttgtgtaccggaagctctttcaaacctgtttcctgagccatcaataaagtttataccctgcatatccctgcatgtaagtctagatttcttttgaaatcactgactcttcctaagaatcttctagaataaatagctttgaagtttctttgaatataagctcatctaatgttatcaaatagctagagggtctcccaatgacattatttgcagaaggtctcactgagagatccacacatgtactttctagagctggccagagatttgaagtggagaaaagctttgcttctgcagtctcagagtataaacatgaaatgaaaacagtggtactaaaggcagaagcagcaaggaaacaaatttttttcaaaaagacaaaggttggggtaaggctggggaaaaaggacaaatgtgccacaagaaatttcagcttccaagagatttgtacttttcagaattgacatttatccatacggcgaaatattattcatccataaaaagaaatgaaatactaacataggctacaccacggatgaaccttggaaactttatactaagtaaacgacgccagtcttaaaaggaccacatgttctacaatcaaccttttctattcattcctcagaataagtaaatccatagagatagaaagtagacgggggagagcctggtgctggggaatttgggggaatggggagtgactgctaatgggtccagggttccttttgggggtgataaaaatgttctagaaagaggtactggtgaccaatggacaactttatgaatatactaaaagccactgaattttacatgttaaaagagtgaacttttcctgggcaacatggtaaaatcccatctctactaaaaatacaaaaattagctggccatggtgatgcgtgcctgtaatcccagctactcgggagggtgaggcaggagactcgcttgaacccaggaggtggacgttgcagtgagccgagatcacgccactacactccagcctgagtgacagagtgagactccctctcaaaaaaaaaaaaagaaagagtgaactttgtagtttgttttatctcaatacagtgattttttttttaaataaagtcttcacataaaactctaatcctaattggtagtttccttctttttagcttagaccaccagaaacatcctggacttcatccgtatgtcagattttaggatggtaaaacaagacgccagtaagcaaagcagttgttttacacaccttagaaagcacattgccagacatgagaaggattcccaacctgtgttatttctctggctgctgagtacttgaatgactctaaaaggcaactgagaagaaaaattccatactgataaaggagcacacacaacttaccaaatttgctttttctcttgctcttcttttttgttcttctgatttcaatttttcatttaaagcatcattttcactcttcagatcattgatttgcttctaaaacacaatgaaatgtggaacttaagttaacaagaaaaccccagaaactcagcatacgtacacagaaacattaaaaccaaacaaaatcaaaaatgatatttttttttgtgggggatactgggatattgacattcacccacctctagcgattcctgcttctcagaaagtaaatcttcaagcgatttcttttctatttcatggcctttcttaatttctgggaaaataaacggatatttttgaggcaataacattctatgagatcaatgtactctaaaacagttaaagcatatagatgtaggggttgatgatgaagccgtatgacgttactttacatctatagtatgcttttatgtaaattggccatctgttctcaaaatggccttgagaggtggttagggtagacattcccattttatgactgagagccctgaggcccactgaagcccaccatggcccacagaggccatgcgaccttaggacaacactgagtgccatttcagggcaggctctcataaatgccactccagactcctggtctggaaaccctgtgctcttttcaatttgctcttcataacctaaacataagtctaaaattatactcatttctagcaggaaggaagaaaaacaatgttcactacaagtctgcctggagccagtcacttttacacattatcacctctgcctgactttgggcaactctatttttgtggtgagaaagtccttgctgaaggtcacacagccggttcttagcactcatccacgctgctctgtaagatgcaactggtttagtagaaagactgtgagcgacactgccgattctgttctgaaagcaatggcttacaccctcccactgatgacagatgaaaaatagaaaagactatttttctattcaataagtggcatcgacatttcacagcaacactgctgtgcaggagcacttggggtggatcctttactgtggattacaagatagaaacttgtacttgccacttcccagggacctaagctggcaaccaccaccgccaaaatggcctttacagtcttccaaagcccatcctatttaacacaaggctggcatttgtaactattatttgcatccttagtgggaaaaggcatctgttaacaataaaccacgcaaaaaggaaccaagaacaccccagcctgaaggccacagggcattcgctgaagcaggaagttatgaatcatttccatcttaaaacatcatgtggttccttcagattttattctgtttaaagaggaaaaaaagcatccttgcctgaaagggaggcttcataggccttctttagcaattcaagtttctctgagtggctagcttcaatttccaacttagaggtttcatgcgcagcatttaagttgtcaaactgtaagcaacaaacaaaaccgtggtttaacagtaaaaccaaatgtcctaagttgaatacgcaaagcaaccacattaggagacgtcacagcttcacaggtaagcgtgggctctagtttaaaggctcctcaacacatacaaaggtcagggcagtggttcacacttgtaacctcagcactctgggaggcagaggtggaggatcacttggagcccagcagttcaagtccagcctgggcaatgtcgcgagactctgtccccacatgtgcacacacaaagaatgcatgaagagcaacgcaactgggattcaccgctcaactctcctctgtctccttccctaccctcaggaacacagacacagaggctctccagggtgacagatggaaatggctgcatcagtcacaaggaatgaccaggaacgaggatatgtttcacagtgacagggccacatgctctgcgcctgtcacttgaccactcaggccctagcatgtgcctggcctggagtaggcactctgtagatatttactaaatgaaaaactgagttaaaaagggagctacaaaattaaaaaggtttgatattttattcagtgaaaaaaaaaatgggatatttaaacagatgccactaaaaaaaaaaaaaagaaagaaatgcaaaacaatagtttggcaacacaccaccaggatgtttacaagggattatttctgggtagaaagaaagggttgttttttcaattttatcttttcctcctccttttcttcccttctttcacttaacataatacattcctttggtcataagaaaactattcaattaaaaagatactgtttccaaggcaggcggatcacctgaggttgggagtttgagaccagcctggccaacatggtgaaaccccgtctctactaaaaatacaaaaattagctgggcatggtgatgggtgcctatagtcccagctactcaggaggttgaggaaggagaatcacttgaacccgggaggcagaggctgcagtgagccaagatcaagccactgtactccagcctccagcctgggagacagagtgggactctgtcttaaataaacaacaacaacatgctttttatacctattagactaaaaaagagaagctcatcaagatgtgaagagcaaccaggattcaagtaagcagcagaggcctcagacaagctctggctgcaaaagcacagacctgctcttgcaattgcattttgtacttctctgcttcttcaatgtaagtgtcccgaagcttttcatactccctggtgtaaaactctttaagccgattctctcgttctgttttttcagcctggtgctgctggacgaatgcttcatacactgtttgtaactcattcctggctttttctaatttctcacaggtggttgaagcagtgactgaaaacagaggagaaagaagagggaagaggtcattttatttgtgaaatgtcctatattcattacagtcacacacagctgtgatgacacctgaagcatacacccatgatgtcttgggtctctagtgaccatgtcttcaaatataacagtatggaagtgaactgtaaaaaggaacacgagggcagggcgcagtggctcacacctgtaatcccagcactttgggaggctgaggtgggggaatcacctgaggtcaggagttcaagaccggcctggtcaacatggtaaaaccctgtctatcttaaaaatacaaaaattagccgggcatggtagcaggtgcctgtaatcccagctactcgggagggtgaggcaggagaattgcttgaacccgggaggcggaggttgtagtgagccaagatcacgccactgcactatagccggggtgacagactgagactccatctcaaaaacaaacaaacaaaacccccccccaccccacattcaaaaaactgactcccaagcagtaagagaagtacttcagaagacccaggtttctaagagaagatcccctctcatgtggtgaccagtcaatgcagtggtcaagaaaagagccttggccaggcagagacatttcttaggacaagcgactcctccctctcccagccagccagtgtggtagaagctcacacaagagcaggaaagacgagggataagaaacaagtggaccggccgggcgcggtggctcacgcctgtaatcccagcactttgggaggccgaggcaggtggatcatgaggtcaggagatcgagaccacggtgaaaccctgtctctactaaaaatacaaaaaattagccgggtgtggtggtgggcgcctgtagtcccagctactcgggaagttgaggcaggagaatggcgtgaacccaggaggcggagcttccagtgagccgagattgcgccactgcactccagcctgggcgacagagtgagattctgtctcaaaaaaaaaaaaaaaaaaaaaaagaaacaagtggaccttaaacttgtagttaatttgagttgattataatttgttatttcaaaactaataaaaataaaatattagcctctattaaacgcaaatcaccagagcacaaatatcttagggaaaaaaaaacacatcttaaaagcacccacataggccaggcacggtggtttgtgctataattcaagtattttaagaagctgagaccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagagagactccgtctcaaaaaaaaaaagaagctgatgcaggagaatcatttgcacctaggagttcatgaccagcctggacaacatagggaaacccatctcttaaaattaaaaaaaaaaaaaaaaaattatccaggcatgatggtgtgggcctgtagtccctgctactgaggaggctgaggtgggaggatcacttgagctcaggagattgaggctgcaactgttgggcaacagagcaagaccctatctcaaaaaaaaaaaaaaaaaaagcaatataaaatgaaaggttaaaaaaatttatatatgtatacataggtacatatgtgcacgtatatatgcatacatatgtatgcatgcatatatgtatatatctatgtgtacatgtgtatatatgtacatatatgtatgcatatatacatgcatatacatatacatatataatacatatatacacatatatacactatatatatagacacacacacacacacacacacacacacacacacacagagtcttgctgtattgcccaggctgaagtgcaatgacacaatcttggctcactgcaacctccaactcccaggttcaagcgattctcctgcctcagcctcctcagtagctgggattacggcacatgccaccacgaccagctaatttttgtattttagtagacacatggttttaccatgttggtcaggctgttctctaactcctgacctcgtgatgcgcctgcctcggcctcccagttaatatattttaaaagggcaaagtaatctgatacacataattgaaaatcagaacatcttagctcttccctacaactaccaaaaatagaatgactaacaatataatacatggcagaacacaaccaaagatatatgtacacacactacaataaatcctagaaaatcttgaattccttaggaagcctgactttggacattcccagtcttctgtcaccgatgtgtaaatacaggcagacagggtactactgtaactgtcagggatacacatgctgtccacatccccagagtactcgtggattaatacgacagggttgctggcaaatctgttaaattaacccttacctctctttggaaaggaataacatatcaggagttgaaggaagaagattattttagggcacagaaaaggacaatttagatcaataattatttggcctaaggaacgtgaaaatggcaggttcttaggaagatttcctacaatggtgtcaacttgttatctcaggaacctgccatgtggtggtagaaatacccaagtcacttgcccccagtcagtattctttcagaggaaaaggaggccacattgaaataatggcaggaatagtgtctgccaaagagaacccttaaaaattaaatcaatctacaaatgtttattgaagggcaaagatttaacattaaaaaaaaatccccaaaacaaaaactatttctcgttgcctggcacagaatggggctctttatcttgtttaaccctcacagaggaccctcctaaacatatagataaggaaaccgccacagagaggctaaatcatctgcccaggggcacagagctggcaagcgtgagaggatgggtttcggtgagcagtctgaattctgattctgcctgcacccaaagcccgtgccccttcttttctaccaagctgtttcttgtgctggggctggcaaggcgcatgatggggcctctactggaagagacaacagacagaggagaagtggcaggaccaggccagaccttggggcccagggagtggcactcaggatagtttacgtccagtcagggtggaccaaaggtttggtcagatttttaaaacaattaaaaaataaataaataaaaactgtgatgagggctgggcacagtggctcacgcctgtaatcccagcactttggaaggccgaagcgtgcagatcatgaggtcaaaatatccagaccatcctggccaacatggtgaaaccccatctctactaaaaatacaaaattagctgggcgtggtggtgtgtgcctgtagtcccagctactcagcaggctgagtgaggcaggagaatcgcttgaacccgggaggcagaggttacagtgagccaagatcgcactaccgcactccagcctggcgacagggaaagacttcatctcaaaaacaaaaacaaaaaaactgtgatgaagcagataccaaattaaccattttaattatttttaggtgtatgattcagtggcattgaatacacttacatcgttgtgtaagctttgtcatcatccattctccagaacgtttccccccaacctgaaacttcgtaccaattaaacagtaacaacccatcccctccccttccccaaggccctggcagcgaccattttactttctttctctatgaatctgaccattcagtacctcatatacctggactcaaatagtacttgtcctgttgtgactgtttatttcatttagcgtatgtcctcaaggctcatccaagctgtgggatgtgtcacaatttccttccttttgaaggctcaatattattccattgttggccgggtgcagtggctcacgcctgtaatcccagcattttgggaggccaaggcaagcagatcgcttgagttcaggagttcgagaccagcctggccaacatggtgaaaccccatctctagtaaaaatacaaaaattagcggggcatgatggcgcacgtctgtagtcccagctactcgggaggctgaggcaggagaatcgcttgaacccaagcagtgcaggttgcagtgagccaagataacgccactgcactccagcctgggtgacagagcaagactccgtgtcaaataataataatgataatattccattgcacgtacagatgacatttgtgtatccacttaccatccacggacacttgggttgcctccacctttggctactgtgaataatgctgctatgaacaccgggggacaaatacatgcccgagtccctgctttcaattctttggtgtatatacccagaaggaattgctgactcatatggcaattctattattaattatttgaaggactatggtactcttttccatagtggttgaaccattctacattcccatcagcagtactacacacaagggttccaatttctccacatgctcaccagaacctatttgattttttcaaatatatgtaacagccatcctaatgagtacatcactgtggttatgatttggtcagtagattttcaaattaagccatatgatagaaataaaattgaggcatcaaggatgaaaatcctatcccagcatgagcaatgatgggcgacagaacggtgagccttggtgattaagaaactcacaaagcagagaagatagaacccaaaaagacagacggaggccagattacaggggccatcgcacgcaactcaagcctttgggactgaatattaaaagtttcttttctcctttaaaagaatttagtgaaagatagtgatggtcttgactgctggagaacattctctgcacattcacttttccttctattacactagtaaccacagaagaaaaaatgactcaagaagtccaatgttagtcaaacgagtaaacactgcattagcttctgccaagtaactttccgactctgaaggctcctcgtgtgaatctcgtattagaactttctatgaaaacctacaacagaaacatactttgcaagccgttggtgaaggtatcaaatagcttctagtcagagaaattctagtttcacgcaggcttttcacttgcttctcttaaaatttccggtatttccaaagttaaaaaataaaaaagcaggaacaagatctgaacccatctggaagctcatatctgggacagaaacatctaagtgaactcagggactcagcaataaacaagagactgcctccaagccctgggctagaagagcttcgaagctgacgttaatagcagactaccctggctgattttaacacatctgtttatgataaaaatactgtcgctttgaatatgtaattgtggcacatcagcctttaaaaccaaataggatacacagaagtcctttcctattagccatgggacagggctgtttccctctattcaccaaaaaaaaaaaaggcagctctgacgttttgataagtgaggtgaagagaggacacatgggaagaaacgggaaagagaaagggagaaaatgggtcagatgggggaacaggaggttcactgctgttattgtaatagtccaaagcagcaggcccagccccagacagtgacatcagcctgcagctgtgcacagacctttgctctgtttactggcccggtgtgctgctggggaacagctgggctgcagtaatcgctcacactaatggctttcgtttgaaggaagtggcctgggctgcgaaggaaacatttatttggcataaagactcatgaagtattttttaaaggatgcacatgtaaacgctgtattaaaggttctcagagtgctcctcggcagctgtgacataaacgtgtgtgtgtggcggtggggggcgtgcataaccccgattttaggccatggactttcctgtgcactgactacagcttaggagagatttatggtgccacctgtgtgtgctctcactcctatcctcagcctagtctcttcttgctcattctccagaattccactcactttcaattaatcagacaccccacaaagccaaaaccaaacataaaattgtttcgaatttgcaacaagcaagcatggacatgcgaatgtttgaaagaaggtattagacaaacacaaagtcaaagtagtctttttgtccctattttttttttttttttttttttttgagatagagtctcgcactgtcacctgggctagaatgcagtggcacgatctcggctcactgcaacctccacctcccgggttcatgcgattctcttgccacagcctcccgagtagctgggactacaggtgcacaccaccacacttggctaattttttgttttttagtagagatggggtttcactatgtgggtaagactggtctcgaacttctggcctcatgatccgcccacctcagcatcccaaagtgctggaattacaggtgtgagccactgtgcctggcctctgttgttttaatcattccattagtctattttttaaaaaagcacatatatgattaggaacaccaacagaccaccatctgtaggagaactgctgggcaacttttgtatacatgtttgtaaaccatgaaagctatctccagcaatctagcttaaaagaggaaatacagttctcaggatttaaggaaaaagagaaaaaaaaaaaaagaaaaaggaagaaaggaggaagggagggaaggggaggaaggagaagaaggaaaggaaggcaaactcatgtacaaaaacatctctaaaatgtaaggccacattgagattagaagtcagtattttcactctgcaatgaatcacccaagaagaattctaggccagtgaccctccctgacagtttaaatcatggatatctcagcaagaaaaaaaaatcgtaatcagtgaaatgctttaagttttgcttttcaagtaattatcaagatgatatgtggaaaatgcccagtgccacagtcaaacataatctctggaaaacagagctggagtcctcccaggtccttcattacttagccctgcagaactggagtggagccattacttaattagtcctcatggctttttctcagaggggaaggtcagacttttattatttccatctcacagagactcatttccctttgttgattgataaatgtactgtttacagagaaaagcattacacagccatggcccgacattgttaatattcttttgaaatgatacagtgctttcctagtttttatatctgagtagcatggttcattatgagacgaccaaaaatattttaatgctcaagaacataaataaatgtcctaataggatagagccaaaattacttgggttcaaatctcagtcacaccactcagctgctacatcacttgagcaaattacttaaactttctaagcctactttttgttttgttttgttttgttttttttgagacagaggcttcctctatcacccaggctggagtgtagtggcacaatctcagctcactgcaacctcggcctcccaggtttaagcgattctcctgcctcagccccctgagtagctgggattacaggcatgcaccaccatacccggctaatttttgtatttttagtggagacagggtttcactacgttggccaggctggtctcgaactcctgacctcaaatgatctgcctgcctcggcctcccaaagtgctgggattacaggcatgagccaccgcacctggcctaagcctacatttcttcatttttaaagtggagatattattagtcccttctctagaagatgaaatagcacaggtgaagcactcaccccagtgcctgaccacagtaactttgcagataaattgtataactgttacggcttgcaagagtccattgattccagtgtgtttgaagactcctggaagacaggcttagggttccataacagaaatataacagttaaaaagcagcattgctggcctcgtattcaaatttgatgcatatgaacacacagacgtagctattatggtggagtgtacactcacttcaagtctttcccttccgctactattgttcttgacattatacgcaatagaattttcctaatttggaggagattttatgtaaatcagaactaaaatataaaaaagaaaagtgccaggcaaattttcatagcgccacataagagaataccatagaaagaagagacgaacaggaaaaagagatgattccattcccaaactgcacacatactcctttcccagacgctctggccagcctgctgtgggtggcgactctcccccaccccaccccgaaatccccctctctgcaccatctaggatggagaagagcagcctgcctccagctctgcctgcagtgggcccctcactctctcttggccgcctgggaaaccggcctcctcctctcagttctgggctccttcacttctttcttcaacagtacatacccattacacttctcggggtaaacagaactgtcacttctcttgtgccccacccccagaagcaggaggggacactacattctaccgtaggagtgtgatgatgtcataacattctactaagggaaatccgaggaaatccgatcctgacacacgtccatggcaagcgactatgtaggtgacccccttaagccaaggtctgatctggtttgaaactggaggtagtaacatcactgaacaagtaaccaagaagtcatttttaaacatcaaattgatgctttgtggacaggcagtggcctaaagaagaaaaaaaaggtgggacccagactatcccacaaataggcatgtccagtttcctgggcctccgtgtcctgatatggaaggtaggaacaaataccacctgttctgccaacagtatagattggtgatagtaaagtgaaacagagttactcttatgctttgtagaaagtcttcccagcctgtggaataatcccctactcacatagtgccagggtttgcctctctaaagatactttgtcaaatgaccaagaaattttgcagacaagtggtagaccaggttctttttctacatttccaaattatctccaaatgcctttctgattactcctgggcattaaatcaacaaatcactaagagctcatttcaaagtcttccataaatcataaattattaggaacttgctttttacaaaaggcctgcacaatcaaatcaatcctcccataaatgccacttcacctttaaaactcagttcatactttacaaggtgctctcacatttgtttcatttaatgtaacaatgctctgaacgaataaaataggtattatcagacatctcattttaccaaagaagaatggaaataacggagctggatctacaactccagcctctttgttgttgttgtgttttgagtagatatggggtttcaccatgttggcaaggctggtctcaaactccgggcatcaagcgatctgtccacctcagcctcccaaagtgctggaattactggcttgagccactatgcccggccctagaactccagcctctttgagagcctaaccacagaacacccagcgggatctgactggctatttttcccagcctgagatgtagaagacaaagttaattcacacgtaccatggatgcctcagggtagtagggcttaattctcttgtggaagcactgctgaaaagattccaagataaggcaggtaaaaaaatgacctttccccccctatactgggtagtgctgacaaagtgtgactcacaggtgggaagacaattccacccagccagcctgtcttccatctccatcttggtgcctaggtaccagccgggcctcccctaaggttctagcctctccctgccagtgttcctcctcccacccttgaagagaagcctgcaaaggccatttgctgtttttcagctcattcactggccagcatgctgcagaacagatgcttttttttttttttttttttttttaaatcacaacagcaaacactccgtgtataaacgaacacatttaggaataaaagtgggttggaggcgagagcacagctgaatatctgacaatatgttctaagattcaggcctgagaaaaagtgaggctgactttaaaggaatcctgtttcaatcaagagtttcaatgtaaaaaaaaaaaaaaggatgattttaagtcagggactattcattctgcctcttctcctcactgacggatcatttttagagcacgagggtcaaaaaggctgctaaaagtccttggcatgtgtaaaatttaaaagcttatttataagaatggactcaattcactcggagttacttcatattattcttactatgcttgagatatgtatgtatttttttacataaaagaaacaacattctaggcagctagagcagtgtcaaagggtagtcctggggcacctacatgagaaccacctggatgatcattaaaagtgcagattcctcctcaatttccattaagggaaaggttttgctttatttttctttgcaggtagccaaagctgtactcagatattgctaataaggaagaaaaactggtctcctgttaacctgaggacactagggccagaggtcaggaagagggatcaccttccccatcaacacaacatctttttagaagtgctgcctctccttctgtaattgggaagcacctattactattccttaaagcccaaagaggggttagtaggatgatgggtataggagacgttggggtttaaaaaaaacaaagtgcagattcctggacttcatccccagccaaccaagtcagaagcaatgggcatgagaactgaggatctgcatttcaaccaggtctattttcgtacacaataaagtttgggagccactattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttggttttcagtatattaatagatttttcattaaagcctacttcaagaaaagtcacttctggaattttacaactcaaaagtgacttacctgtaaagagtttaaaaattattttaaatacatagccttgttaaaccaaaattgtagataaaaacggaacagtgaatgaatcaacacattccatatggcgtgaggcaatgtgaagttcatagacactgggttaagtgttgattaggcaatgtgtatactgcttttggcaatgtactgttttttgcaagttactttcctcagtaagatacattttaacaatatttcttaaactcttgattagaagaaaaatattccaaaagtagctatcaatgcaaacgagcgtttatttcaaatagttttccaatcttttaaatcatttcatcaaactttccctgtggtgactaccagaagattggtggtctagccatcttgggttcttatgcaagctctttgctttccagcttcccttgggaagttacttaacctctgagccacaatttattttttataaatacaatgcagagaagtagactgagagctgaacattgtttgttagggatgagtaggcaccaaacacacgatgttgttatacctagctcataattttcatgcacaaaaatcaactggtctttttacactattataggaagggcaagcatttttagtgaattaaggattaaaatcttgtttcacaaaatagaaataatcaggactaatgtataaaaagatgagagttagctgttaattgtgatggctcaaaaataattttgaaatacaaaataatcttcattaatttagatcaagcttgtccaactcacagcctgcacgtggcccaggacagctttgaatgcggcccaacacaaatttgtaaactttcttagaacattatgagatgtgtgaatttttttcttttcgtcatcagctatttgctagtgttagtgcattttatgtgtggcactagacaattcttcttccaacgtggcccggggaagccaaaagattggacacccctgatttagatgaaaagtctgattccaaggattaacattaatgaaaagcaaaaagaactctaaagatcataatcatggccctctattgcaccagctgttattcaacatgactctggaaagaatcttatcctagaggcaaaatgtctgctgcagatgtagaccatttaactgtaatctatttccaaggctgacactttcaaaatgatctgattaactgggattgtcggacataatataaaatgtatccaagagagttacagctctcctttatgactatgcattcctaaaggacaattatcttttcttttcaagatgtggatttcattttttaattattctgactctgctttaaacttttattttaggttcaggggcacatgtgcaggtttgttatttgggtcaacttgaatcacaggggcttgttgtacagaatatttcatcaccccggtactaagcccagtacccgatagttattttttctgctcctctccctcctcccgccctccaccctcaggcaggccccagtgtctgctgttcccctctttgtgtccatatgtgtttgtcatagaaatgttaaacggtttatagaaaaacatttgtgcataaaaaacactgagtattagcatattttaagaagaaaactacctttccctagctaccactgttggtaataaaatcattcattgattgaagtctaagcacctgctaagtgccaagcacaaggtgggagaactacaaaaattaaggagctattggccttgcccttgaagagttcctaattctagatggcaagaagaggtctataaacaaatctctgtaagaacaaaatcttaaatgtgtacagggtgctttgaaaagcacactagaaggcacagttaacttacttgaaagatttgggtgaaattcaattgaagatattttagctaagacttaaaaactgagtaaaagagaaggagcatgaggggtccgcgacgggaggggagtggaaagaggagagtgcactccaggcagagaggataccgtgcaaaagatgtggacaagaggtgcaaatgaacccatggccggggcctgggaggggaaaggaggtctgaacaaaggggaaagagtgcctagacgtgaatttggactggaagatttcaatcagtcaaatcataaatggtgtgcttagtatgtctggattttttcccccaaggccaaaatagagtcttttgtgtttgttaaaaatgtccagtacaggccaggagtggtggctcaagcctataatcccaacactttgggaggccgcagcaggtggatcacctgaggtcaggagttcgagaccagcctggccaacatggtgaaacctcgtctctactaaaatacaaaaattagccggccgtggtggtgcgcacctgtattcccagctactcgggacgctgaggcaggacagtcacatgaatccaggaggtggaggttgcagtgacccaagatcatgccactgcactccagcatgggtgacagggtagaaaactccttctaaaaaacaaaaaaaacaaaatgtccagtagagacacatgtcagcctgactctaagtacagatcctggccgcaagtggagttgggggcgcaggcctggaggcaaggtgacccattgggtagctgttgcagtatcttccaggtgagaaattgtgggacttaaaacagcagcagccagaatgctgagcagggatggatccaagtggcatttaggacacagactgacatgcacgtggaggatgggggaacaggagtatgatttcagttgttagcttgggtggtaagtgaatcatatcgaccctgccaaagctgaggaacaggggtgaatgaggagacgctgcatggcgctcaggaaggaaggggctggaccatcaggaaggtctgattatactggactggctcacctgggggcagcccctcactgggaagcatctgcagcttgggaaggagagaactagaaaaataaatctgtgtcactgttgtataggtagtagcggaaaccatgggaatggatgagaaaacagctggcaatgaaacccttgctatatactatgacactatttaaggggtaagtgaacgtatgggacagccacttgacagactttcccccagcccattaaaggtgatcataatgaacactatgaggcaatgtggaaaagtgcttgacctatccagtgaaaaagatcacagcagacatctgaccaggtgccatggctcacatctgtaatcccagcactttgggaggccgagacgggcggatcacttgaggcaagtgttagagaccagcctgaccaatatggtgaatccctgtctctactaaaaatacaaaaattagcccagcatggtggtatgcacctataatcccagctattcgggaggctgaggcaggagaactgcttgaacccggaaggcagaggtcacagtgagccgagatagtgccagtgcactccagcctggcaacagagcaagaccctgtctttaaaaaaaaaagattggagcagacacttaacatacacaaatctcaaaagtattatgaaacaagccagagacaaaaaacagcatactatatctttccatttaaatgagaatctagttcagacaaaacctttgataataaaggttaaatcagtgtttgcttctagggggaggggtgttccactgtgaaatggcatgagggaatttactggattgacagaaatagtctatgcttgataaggatgtaggttttaggagtatatgtctgtcaaactgatggaataattagcattccgctgtatgaaaattacaccttaatttaaaaaatcgtagtatgaagttgtatatattcatataaactaagaaaagggaatatgcaaataaagttatgtcagggcagtggagctgccggctgttttcttttcacttaaaaatcttaattttcatacattgttctaaaaaaaaaaaaaactttaaaacttaaaatacccaaaaatatttatcgagtacccaagaaaacagaaagcatattatattatttttccataggaaacagaaaagaatccctacaattatggactttatacctgaaggtaacaagaaaacacgagacagtaaagacatcaacgtagagtatcaaaaaatcactggaccaaagggacacttttaagagtttctgcagaagcaaagaaccagtgcttccatgaagggagtgtggctcagacagtggaaacacacaggctgctttggacactgccacagtgagactgagggaacaacgggaaagtcagtggatgctgggacagctggaggctgttagatgcggaaggtggaaagcacagactctacctgggtttcagtgctcctgagtttatgaactgtcctttttctttgcagttcttagtagtttgggtaccttgtctcaactttcattgagaaggtgaagaaaaattacccaatgggagagtgacaccaactcccatcgccccacccccattattttggagggaagaagtgggtgctttgatgacggcgatagtggcagctctcttttcttgagttgctgtgatgggccaggcactacaccactgctttatatgcattactattttattcaagctccacaataacgcagcaaaatacatactgatttcatatcaccagcgaaaaaaccatactcaaagaagttaggtaacatccaactaggagtggatggacaaaaacctaggctttgactccacacaccacactctactggatcaggagaatactctgatgaggtctcatttccacttgagtttgaagagcctgtcgtttgggatttctaggaatatttagtctaatgattattcctttctgtagcatagatgatgccctcacaaaacagccagtgtggttaattactacacagctgtcaagctgcatacatcctaatacctattatttaatagcagttaacacttggtgctagatgctttacaatgcattacctcatgtaatcctcacacccacccttggggcagacaattagcatcgccatttttaccgaggatgaaattgggacagaagagatacaaagtgacttgtcctaagtcactcagttaccacaaatgtggccccggacagtgtgacaacatcagcctaaccactttactgcctcaaaatttaaaactgggttcccaactttgctatgtcaatgtcaaagttagtttcatgctgaaactaacaatcccactggcagccttgagagtgttcttcctggaccgcttcatcacaagtgtttacaggtttcgcttccctccacttacagaaccaaaacccttctccaaacggagaacggttaccatcagatgtatgcctgctgcaacagcagcaatgacacattccctaagaagccagcactgggtgactggggatctggataggccacccactgtaccaacactcgggaggcaggagaagcagtgcaccaggacagcttccttatcaaggataggaaggtgacagtgggcacagactgttacagctatttcctgtcaggctacctgactcactggaggtgctgaatccctgggccccaactgcggttgcttaattgtgctgtccactaaaatgtaaaaagagcatccttcattgaagcagagcgaatgggcacagtgttccattctcattgctgccttgtcttcggagagaggctgaaatgtgaacctctaggtaggctcacctccacttccactgggttataatgaactctgaaacacacacaaaaaggcctctttcctgatcttctaactctgttaattatgttatttaaggcatggacaaaagcaagttgggttggtcatttaggtaatcataagggctgctgtcaagttaagtaacatggcagaaagcctgcaaagtctgagagctgggctgtctctcagctgggatttccttgaactgtttcaccagaactctcaagtctttgggattctgaagtttccatctgtcttaaaattacttttccataaagaggccttcatttccacagcctaaaataaagtgaggactgatgtcttggctaggtattaagaatctggacggttagtcagggatttggcctcacctcccactggaaggggaaaagggaagatgaatgcagagaagtcttttacagagtcttgctctgttggccagactggagggcagcagcacaatgacagctcactgcagtctcgaactcctgggctcaagcaatcttcccacctcacactccagagtagctgggacaacaggcacacaccaccatgcttggctgatttttaaattattttttgtagagtcagggtcttgctatattgctcaagctggtctcaaactgctggcctcaagtgatcctcccacctcagcctcccaaagcgctgggattacaggtgtgagctaccacacccagcccagacaaagtcttgaccccacgttcactgccgtttgatttctgctgtggtgaaggtgggagaattaagagtgttcaaatccagcaaatcaggttggcagtgtggtcttgtccaaaagaaaaaagggcagtttctcctagagttgggtgaacacaatttgcttctctggatgttaccttgcattattcatacaacatacctgggcatattttggtggagactgtaacacacacagaaaactgcaaagggcaaggaaataagccctagaatggtcagctccagatctggctgaagctgaagcaggaagttgattctctaggttgaggagcccagggcagagagaagaaccccaaagcggtcagatcactccaagatacgagttgacgtagaaaagggagtgtcggctgggtgcggtggctcacacctataatcccagtactttgggaggccaaggtcaagagatggagaccctcctggccaacatggcgaaaccccatctctactaaaaatacaaaaattagctgggtgtggtggtgtgctcctgttgtcccagctactcggaaggctgaggcaggagaattgcttgaacccgggaggcggaggttgcagtgagtcgagatcgcaccactgcactccagtctggtgacagagcaagattccgtctcaaaaaaaaaagaaaaagaaacagaaaagagaaaagcaaaacaaagcaaaggcagtgtcgtgtctgttccatgaaccctaagggcttccaggagagaatggaactaaaataacagcgtagcctggaaactggagggctgggtggtgggtgttgagacctggaaactgcagggctgggtggtgggtgttgagacatgtaaactgcagggctgggtggtaggtgttgagacgtggggctccctgtggagcggggaggtggtgaaccatcagcccccctccaaatagtaagattagcatagaacgtgcctttttcagccaagttgccttcatggacagcatcctttcaacttcatactcactactcacaaaccaacccttggaagtacaacggatttactgtttatcaagaggggaaactttcactattctcatatgaaaagtgcttcagaaaaaaaaatgacaacattatttaacaggaattcacacaattacaaaaataactctgtccctctcttcagcaagagaaatattttgctcatcagaagttctgctaggcttagtcagatcagtgccaggaattctgtgaactgaaggtcaagctgccaagattcaaaagaaatgtcgatagtaagtgtttgcccagatactagacagggagtgccaacagctcccagcatgcaactccagccacaacgcagacaggacaaccacattttccagtgttccccttgtcccataaaatttaacaacaacaacaaaaagctcttacctagctctccccggaggttaacaagttcttgagatagggttttgtgttgtttcagtgcttcctcccgctgcggaaaacacacatcaagttactcatgctttcaagagggtccctttcagtaaggtacacatttgttatcactaggaaaatgagacccagtattgggaagccaagatatgaatcatttaggctaacaatttgtgttgttaaaagaaacacagttgtcccttagctgttaaggaaattcgtaattcaaaaatctgtatttttgcaggtcccagtgaaactttggtttgacgcagtgaatggcccatttagaaatatttactttgagccagtgcttcactgctgatccatagaacctttcggctaatgcatactgtacttaagatgtaatgcgttctcctcctccaagggcaataaacatctaatcagtttaagataaatatttaatgttctaaacataagcacatatatgcactttgtcctatatttgcacataaaaaagtttcgttacaatgccaatccttctaaaagaaagacaaaaagtttgttagaaagctatagcagaaagataatcctttaaagacaaaattaaattaatttttttcagctacataccattttctaaggattatgatattttggatcagtgataattctaaatcgatgttagagaaacaaaccaaagaaaaccggatggctgtttttagtatcagagaagcaagtatcaaccttgagctgaagaataatgttcaagttaccagcaactcccggcaatcacacatacacacatacttacacaaatacagtaattacatacagttccttaaaaggtagattccctagcaccagggagtaactaaaaaaaaaatgaagaatttcaaagctcgctgaaaaatgccctcacgaggatcacccaagacggagctcccaccacatcctgatcacagcgttgcagagatcatgagacccggcctttgcaggcaagagttgcttgtcattcaaagcattttccctgaattccagacagcctctgcagtagtcctgacattcttccagaaaagcactataaacaaatactaattacccttgttgctgcacatggagaatagaggcacagtttgctgctggggcagcccattttccagcttctgtctccaagtccccccacccctcgcactgtgcaagaagcatacaggtggccgcgccacccaccagtcgggtctgtctacattcaaagctctagcaggaggcgcgccattggccctcgggcgtcttacttcatgtcctgcaggttaccgtgtgcctcggattcctcactcacagaagctgatactgcagcttctgcctttggcacaggcagcctgtgattacttaaagccacagcctttcatttatgaaaaacgagaggcaggcattagactgatcgattgccatttagttaaatatcagctgcaacggaggaaagaaaaaactgaccccctctgcatggataatggagttatttttagacttgtgagcctttttcttcccctctctaattgtggtcattatttgatcacacttactaatagaaaagggaaacttgttcttcgaagcccatatactaaatgaggttatgaactaggtgaagagcaaggaaaggggcatgctgtcgtttacaaatttaaatgacattatgaaatgagaggtgtttcaaaataagtctgaagtgctgatctgagagttggagatcccatatatttttaacttttactttgttctcacctctcagtaagagctacggaagtcaagtctaaacgccagcactgaaacgtggtcagcagggactgggatttaagacccacttttcactgagtacctttctggcttcaatggtattctaaatgcttggtttttaaaaatatggcattaagttgttctgaaatcaccagtgagtcagagtttcttaaaataataagtaattggttttctaatgtagaaattaaagcctgaggaaaatcagcccgcataataatggaagaaaaacataaaaatatgtatcataaatacttctcgtaatatcaaatttaagcctgaattttgtttagtaatctacttcaagtaaacaccaggaagctttaccactcaagtaacaggaaaaacaagacagctttactaaatgcccacaaacaatcctgaaactcatttggtgaacttgcttaaaattcacttttcagtagtaaccaagttactaacagaaggaagagatggcaagaaaattcaatcatttttcaaatttatggaaactaatgggaggatgaaagaaattaaaaattacagttagtataactgcaaagaaaaattgtgtgaaatcattatgttctactgcaaaaatacaccaggtgatatttttgcttattaagggaggttttgggaaagggagtttcaccaagcatgtcgacatttccccaaacttcaactccactgcactccacgttcctgtccttaatgcctcagaaactactgacatcttccaacctctgtcaggcacagtaacagtaacaggaaaaccttgaggtcatctttcactctttgtctaaatgggttgtgcaaaagtcagttggttcttcccttgtaatgtgacaccattcccctcctccaaatgcatagaccatttacccttctaaattggttggtaacttattacttcaaactaattaactaagcatttttcatagcagatgctgtgaaaatataaaagaaatttaagacatggtccctgccttcaagaagcatggggcctacctagaactagaacatccaggctcaattcttttggtcatctatcaaggcagatgacctcatcggatgggaagcagtaatgaaaaaaaccaagggctttaaataccatccatagatgaaatgctgaccccagtgcccatactgtaaaagacacatactaagggttagtttctgcctgactctccctggtagcttggcctttacatgtacttaccctttacttgtagatgataaaatgcattatgtcctttagatactgatttactgtttctttttactcagctgctcctagatcagtgtttctctcttagatgataaactcttaaccgtctagataacaggttgattcaattctctttgtattgtaacatgcagaattacacacaatgtgaaaaaagagaaaggtggaaatctggatataaagatgcctttatgctcaggcattaaatatatgaaatgctcaagaaaaaaaaaatggattcaccataattgaattaggagtccctgggacacaggcacttagtctctggctgtggtcccatcggtgtgcctgcatttttgctagccactgagtagcatcaacagcatagagcatcttgcagagaatagccacatcagatggctcagacgtgtgctgcatctgacctcctccccatcacccacacagtgaatttgctcaatgcatctatgtttttttgttccaagtcaactttactgctagtgccattcaaaattcacctttgttcaggtgctactttaggttaaattccacttgcaaaaaaaaaaaaaaaagatgtggaggcattttgaagaattagaggtttggggagggtgacctcagccctgttcaagtttacctagaaagccacccaatagacccttttaggaagaagcttaattactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagatataagaatgtctgatatgtaatgaaatatgtctgccactacagtgggaaacttatagttactaagtagacttgcaacaaaagcatggtagttgcaagattctcttaaccattttcacccataatcgaaggctctaaagccatttagaaaaggttagcaataacaaaaaatatatatacacacacacacacaaatacctatatattatacatatataaaaatacatagacatacaatgtataggtatatcatgtatataaaaaacatacataatgtatatgtatacaatgtgtatctgtatctattttatatacatatgcatgtgtgcgcgcgcgtgtgtgtgtgtgtgtgtgtgtataaacacagtatatatacttctgtaatgggaatgggaactaaaaggttaagggagtttttaaaattgtttaactttacccatgattttttttctccaactatttttattttatttatttatttatttatttatttattttttgagacagggtctcactgtcacccaggctggagtgcggtggtgcgatcttggctcactgcaacctccacctattgggttcaagcgattcgtatgcctcagtctcttgagtagctgggactacaggcacatgccaccatgcctggctaatttttgtattttttggtagagacagggtttcgccatgttggccagactggtctcaaactctggacctcaagcgatccacccgcctcagcctcccaaagtgctgggattacaggtgtgagccaccatgcctagcctccaactgttttataatagtgctcagtatacattacacaatcagtaaatatttgctgattataaaataaagagagcaaagaacatttacataagactttatgctcatcctacatctggaattccatcctctccgttcatatgttcactcacatatatactgtgttgactattaaagctgctggggtggtttcataagaaagaactagatgcagatcctgccttcagtaaatttcctgtcttaaaaagcaaaaacaagcattaaaccggtatctctaatataacacagacaatgaaagagaagcatatatgctcctggaatccagacgggaacagaacgtagatctagaaggccaggaaatcattcctgagtgggttctggactgggagtggtggatcatgcctgtaatcccagcactttggaaggccgaggcaggtggatcacttgaggtgaggactttaagaccagcctggccaacatggtgaaacctcatctctactaaaaatacaaaaattatctgggtatggtggtgggcatccgtaatcccagctactcaggaggctgagtcaggagaactggttgaacccaggtggcggaggttgcagtgagctgagattgcgccactgcactccagactgggtgacagagcaaggccactgtcgcaaaaaaaaaaaaaaaaaaaaaaaaaaaaaaaagcgggttctggagctgtattcagtgcagtcacaattccttggctgtcaggacctaaatttaagtataaggtgaaattcacacacagtacaattgtctgggaaattcactaggagcttgccatgtttgtggacaatgcatctctctgtagatccaacccagtgaatttttttcctctagcgttggatcaactctctctataactgagcacctgataaaggcctcggcttgtgtttagaggccaggttgcatgagggaaaagtatctttaaacactaagatagcagagagtatagaatgctcacgccacaagaggtgttcggggactgagcagacacatgaaggaagggtggactcctgaccttcatctcaaattgactcccgggccttcgttcactggggggaatacaaggtggacttgtgttcttcatttaatttgctttttttcttttttttttaagttggaatctcgctctgttgcccaggatggagtgtagtggtgcgatcttggctcactgccacctccacctctcaaagtaaagtgattcttctaccttagcctcccgagtagctgggactacaggcacatgccaccacacatggctaatttttgtagttttaggggagatggggttttaccatattggtcaggctggtctcgaacttctgacctcaggtgatccacccgccttggcctccccaagtgctgggattacaggtgtgagccacagcgcccggcctgcatttttcttccttcagttgtttgtgtactgaatctatgtaaattaaatgcaagtggtgatgtgatgctgctgtaaaaccgacctgaacatgtaggtattgtgggcaaggacagcaacccagtaatgatacgtgaacaatggatgacgtacaggaagtttacaggacatttttagttgatagcttcctagacctaggtttacgtcctggttctcctcttgctagctgtctgatagcaggcaaattacctaactctatgcctcaattttcatatttgtaaattccaactcgtgtctttggtgaggatttaaataaggtaagtaagaatatctggcacttagtaaatattaggctggtgcaaaagtaactgtagcttttggcatgatggcaaaaccgcaattacttttgctcaaacctagtattcaataaatccctcttgcttctcctccatctctttatgtacggctacagcatctgggcatgataataacattaaaaggggcagttgttgccaaatgataaagagccttatagtaccagttgaaaaccagactccccaaaacaaaataacatgagttacgtaattataaatttcctagtagccacgctgagaaaagttgaaaaagatgaagctaattttaataacgtattttatttaacccaaatatatatataaaataatatttcaatatattcaatataaaagttgttaatgagatattttacatcctttgttttcattctaagtttttggaatccaagtgtattgtacacttaccacacatctcaattcaacggatttacatttcgaatgctcagtctcatatggctagtggctaccacactggacacatcagctgtagataagggagaaccactggaagatttaatcagcagcgtgggatgctttggtaagaggacgctgtcagcagtgcttgggatggattataggtgagaaacagtacaagcctaatgattggttaaaaaggtgctatcacaggttgggcgcagtggctcacgcctgtaattgcagcactttgggaggccgaggtgagcggatcacctgaggtcaggagttcaagaccagcctggcccacatggtgaaaccctgtctctactagaaaattacaaaaactagtcgggcatggtggcgggtgcctgtaatcccagctattcgggaggctgaggaaggagaatcacttgaacccgggaggtggaggttgcagtgagcccagatcacgccattgcataccagtctgagtgacagagcaagactccatcccaaaaaaaaaaaaaaaaaaaaaagttgctatcatgatctagtggaagctatccagggtctgagcaaggatggcatgaatggggacagcaaagacataggaaggggaaaagcactgtgaaatgagagttcacaggacttgactgacgtcatgaggaggatgaaaggagagaaaacagttgaggatgggggctattaggctagatataataaaataaaataattggtttatttctaaacataaaaactaattgttccccacatttgatagtatacagtttctagttagcttacttggttatataaacacactcttgattcctttcttacaaatgaaagagaaacaaaaataccatatactattaccgttactaaaaccctaagtagtctccaacttcccctcaaaaaaaacaaaaacaaaaacaaaaacaaaaaaatctggagaaagctgtaaaatactcatcaagaaatcattaaggctgggcgcagtggcgcatgcctgtaatcccaggactttgggaggccgaggcagacagatcacagggtcaggagatcgagaccatcctgcctaacacagtgaaaccccgtctctactaaaaatacaaaaaactagccgggcgtggtggcgggtgcctgcagtcccagctactcgggaggctgaggcaggagaatggcatgaacccgggagatagagcttgtagtgagctgagatggcgccactgcactccagcctgggcgacagagtgagagtctgtctcaaaaaaaaagagaattcattgaaactgtctactagtctggtagtttctccaaggcacagaccaagtctcatccacttctctctctccccactccctaaaaaggcagccatattacaggggcctctgtatgaaaccaggacaggtttgttgatctgaacaaaactacagaacaaccaaactgaacagttttctttttgcttttaatttttattttttccctatgttgctcaggctggtcttgaactcctgaccacaagcgatcctccctcctcgtcttcccaaaatgctgggattccaggcatgagccacagtactgagccagtctttttttttcccctttgcattatcatgtatagccatctttaaaactgtgatttaaaaaatgtctgaagagctcaagttgtattcttatcagttgccccctgagataattacagcttttattgctatgtcagtaacatgttgatataaacttggttttctcaatgaattttagccagttcctgaaataacatccctgaagaatattagggaaaagtaacaacacggcaaatctgctttgcttttgttgcaccacagagattgttttaggaataaacagaactttcagaaagaatccccagatatgattcagggagttaactcaaaagtgctctttaatccataaatataactaacgtcatttttcaaagcattaaactaagtgtgatatgaaaagctacacacagacaaacacacaaattaagtgaaaaaaatgctaatgctagtttaggtctagaggcatacaccggcgtaagaggcaattatgttttttgctgttgccattctaaccaacagactctaggggaaaaaaaggaagtgagaaaatgtttccatcccaaattgctagagaccgactcaagtatctggtgaagtgacaaaaatgtaatgggatgaatgacacctgatctttcccatcatttacctagatattcccaaggccagcgtgtgagcaagtcctccccgtgctcccccgacctcaagtagaaaggctctttctaggatgcacctccttacctcagacagcaggtgctgaatcacaactgtcaatgcctcaaacttggtattaccacaggcaagaagctgcttgagctgcaggataaatccactttggttttcacattttgttttatattgcgtcaattcaagtgttttctcagggggcagcgcatcgggagctgtctgtggctggatacataagcttcgaggattcttttgcctgctcttttcaactgcaaaacgaattaacataggtacaaagataggtgaggttaatttttaaaatcaccaccacaaggattcaaaaacaaccagataagccacagaaatccatttaagttatgttgctgtaaggaatgcatatggatgagaactggaatgaatcggagatctagacggttggaattcatgaacagggaccgtggcttcatttatgactttaaaagatttatggggaacagagaattaggaacatgacacaaatggatttggcaacccagaaacacaaaaactgggtgcaaaatgttgttctcctcgtttctcattttccagttaaattggtagagaaaccttgactgaagagaagcctgacttttctgatctcatatgctgaaaggaacacacaaatcactggactttaaattaaatgcctttctctcctcccatacattttctacaaatcttttaccttttccctgatgatggcctagccattacacagatttataccgcagatgagtcatttcctaatctctaataaatcataacatacatcgaaaatatactcagattttgcctctttaagttcactgttaggagtactatactgttgactatactattccattttctatcgaacacaagctttgttggtcttttttcccaagtagtaataacggcttacacagtttttttttaaagcacatgctaacactccaaatccacccaaaatgccacgctaagtgattattcccttcctgtgcaatggtgccctgggtattactctgttttaaataaaaaactgttcagtcttggaaccattccaaatgtgtcattttgaatatcaaacagaattggaaaaacaggacatcaattgcttaggttcttgaaataaacaagccaagtaatccaaacaaatgtaaatctggaaaaaagacacaagaaactaaaaaaaaaaaaaagtttccttattctaacagtctttcattacagcatccacgttctgtggtagcaaatctgaaacaacttttaaagaaatttagtaattactgtctctaatttttcaggaaaaggcaagctactacagtgattgcttaaagaaacatcagtactcactttctaagaacaaatggctaaatatattgaataaactaagttaaaaacagggaaaaaaaggctcttattttctatggctgcattacatggttaaataagtcatatttgtattaatacttgataattctcagttctaaaatcactaaaatatccattgtcccactgtgtctctgtaatacttgatgagaggaagtatttatccattactctttattattagcaattattagtagtagcttatgaataattgtcacttgcatagatgtagaaaatagccaagttaatatcgtaatattacagccctgaaggaagaacaaattattagttacatactaatgaaaaataatctaaatatttgaccatgagattagcattctttcatgtcatttcctaaatgtttttagaaattgtcacataacacataacaattccacagtgtttcgctcatcacagtgtgctctcactttccctttcttttcatcctcccaataaccccagatagggaagagaaggctcacaggtgtgaatgtcttccctggatgtagacaacttctatgggaatccagattcaaagtcagaacccaggcctctgatgctaagcctcttctgttcccacacattttggaaagcggattaggtggtgatgtaatatatgacatacataaaaataaatatttatgcaacaaatgtaataatatcttgctataatacatataagcccattatctgataactcattttaacaaacctacatataaacatctatgtgttatataactttataaacaaaaatgttcaaattctttcactatctagaatttactgtaacaaatatagacacagttcattctcctgatatcatttgtatatgtcctaccgaaacttacttaaaaattcatttattgataactcctttatcatttcctgagtcctgagtaacatttgcctctctttctagaatttctatgctaatcaacgctatttttaacacaatttcagagctttaaaactgttggtttataattatttacaaaatctgagaggtgagtcttttatattaatattttggagaaaatattcttcaagattcttgctttttgcttataaatccgtaacaaaaatatcacagaatacatgtaattgtactaacaatgtttacttttgaagggaaggtaataggaatcagacagctaaaaagtatcctgaagcattttttatactttttaaccatggggtaaatatattacctattcaaaagttaaatataagaagtaaataaaatcacttttaacagacagttaaagtgaaattcgaggacatacattttttatataatacttagctatgaaggaaatagtctatgcagaatttttccttggggaaactacacaggaatctaaacattacgcagggtttgtaagtgattactcaggatagctttatgattaaggaggaaagaacacattgatgtattcgtctaagagtacgtgtcttcaaattttaaaatgagagcaaatgagccaacagactgccctctccgtggcgctggaaactcgtgctgtgcagtcaccatcttccgctccatatactgtgctccctaaggatgaagtgtgaccgcatggcagccgatgacccagtttccacatgcttcccactctcagcactcctggctcagctgaagatcagagatgatgcaaaaatctccaatgacgctcaaaaccccaaggctcatcaatacgtacttcacagtactgaaaagccaggggttcccttaaatcctgcaggattcattactaacgtgaaattagcatattatcagccaaactttgcccttacccttgcttattagcatgttactgttttgataacaaaggttttatacagaagtataaattattttgtttactgtacctattaacagaacatgttctgattttaaagggccaatttaatcagaaaccttaaaattaaacgtcaacttctatatcgattcagatttatctcaacaagataattaccaccatcagctgtgatccagccttactgggactcattctaatgaaatggcagcctccatcaggaaaacgaaggccagaaccaaagacatttgctcatttggaaagcagctggatgaccctgttggctatctttgttctttctattcagaaacctcaatttaataagatttaaaactagtgcaatgaagtcatgtatcatcttcttaaagaaagtagttggttaatgaggaagatgcccatttctcaggctcaaatcacttaggcaaatagacctccaaatcccaagaccaaaaacaattttgagagaaaaacctaaccattaagacatggactaaccgtaaccacatactagcagctgaggacacattcattctaggctgaagaagccacacatttcctcaatctgctggcttttccaattattaaaatcaagttagagaccagacctactgagggagtttgccttgggttccgtgaaacacaaactaaacacagaatttggaaacgaacgttgtccacttttgtgtatactcactgacctactcactcactcatgaaatatatttattaaaatctaccatgagggcactgctgtggtgggtgtgcacctgccctggtgctttgcggggacaggagaagtatcacataagagggtggtattgctcagagaggcacaaagacaccaaagatctctgctgactcatgtttccctagtgctcagctcttcaactccaaatctcaacctatctgtaaaaaggtgacagtcactgactggatggtaagtcctttctacaacatattgcattaaaaaccgatgtttgtgggttgacaaaacataggttatgaactcagaagctagtgagaggtctctctctgctagcggcatggacagacagaaaattcccttttttctgccttaatctaatcgtacacatctaaaagccctcacagggacactgacacagaagttctttcagtcagtttccccagcatctggtggcaggtgcttatcctgcctatgcaatcttacatacagttttttaaagttaccattcatgtcaattattagtttatgtttgtataaagttttctagtgttcattagctgtttactctaaaagagttaacagtaataatttaggagacatatatttttctatttacatataatatttttctatttctaggtagacatggcatttactgaaaatggaaaattttaagctcagcaaagcacagtgtttagacatttagaattacccaagccaggccgggtgcggtggctcacacctgtaatcccaacattttgggaggccaaggcgggcagatcacaaagtcacgtgattgagaccattctggctaacacagtgaaaccccatctcgactaaaaatacaaaaagttagctgggtgtggtggcacctgcctgtactcccagctactcgggaggctgaggcaggagaatcacttgaatccgggaggtggaagttccagtgagccgagatcacgccactgcactccagcctgggtgacagagcaagactccgttctcaaaaacaaacaaacaaacaaacaaaaaaccccaagccaagcccaattatttgtagggggagggaggaggatttaggatgcctcaccatttaaacttttcattactatattggtagaattcgttgcaatagctcatattatatcaaaaagggttctacttcttttcttcacattaaaagcagattagagaatagaaagcatattcgagaatagaaagcatattcatataaaaaattcctgtttgggttaattacgcttataaaatttttcctgaagcaacagtccaaacttgccctaaactattttccatatagctggcaggaaaaaaccaaatttctcatactcttatgtacctaaaatggactcctaactcaaagaagagttaatataaattcaccacattcagaagtacttttaagaaggcattgcctctctcctatagcaaccaaaaaagcatggcactggtctaaaaatagacacatagatcagtggaagagaacagagaacccagaaataaagccacatgcttacagctaattgatctttgacaaagtcagcaaaaatacatacaatggggaaaggacaccctattcaataaatggtgctgggaaaattggaacagagaaactggagacctatctcttatcatatgcaaaaattaagacagatttaagacttaaacgtaagacctgaaaaaataaaaattcctgggtggggggagggaactagaaaaaactcttcacaacattggccgacgcaaggaattcatgactaagatctcaaaagcaaatgcagcaaaaacaaaaatagacaaatgggacttaaactaaaaaggttctgcacagtaaaagaaacagtcaacagaggaaacagacaacctatagaatgggagaaaatatttgcaaactatgcatttgacaaagatctaatattcagaatttacaaggaacgctagcaactagcaagaaaaaatacaaccccaataaaaaatgggcaaaggacatgaacagatgtttctcaaaagaagacacagaagcagccaacatatggaaaaagtagaacatacgaaaaaatgctcaacatcactaatcatcagagaaatgcaaatgaaaaccacgatgagataccatttcctatcagccagaacggctattaccaaaaagtcaaaaaaccacagatgttggcaaagatgtggagagaaggcaatgcttatacactgttggtgggactgtgaattagtacaatctctatggaaaacagtatggagattcctcaaagaactaaaaatagaactaccattcacccagcaatcccactgctgggtatcttcccaaaggaaaagaaaaacacagactatcttataacagaaatgaaaattaaaatagccaattaaaacattaaacattagaaatatttacaatacaaacaataaataaaaagagaacatcattctcaaaatactaaactgtcgacaagcaatttggaagaaacgtgcctaggactcaggtcaccagggagaaaaaaggcaaatctctcaccccaaaagaaagctctattactcttaattttccacagagccacataattgctgatgtttataaaaaggaccctcgtgtactaaaatgacccaaagtattgcctaagataaatacagaaatatgatattcaatattagatacctctaaaatcacacctgttgtgtttctaagaaaataatatgcatatactattaataaaatattattcttagctctgaaagaggctttaaagctcataaaaagcatcattacattaatttatagggtaattatctattaattaaccagaataaattgttctaacaaaacaagtatttacttatatacagcttgccatattcctccagtgtctcttgatgaaaaacactgctatccttcccattctgaatgcaactctaaaccgtaatttattacttactttccatttttgtgtaaaagtagatactacattaaaacataatttagtgtagtaaaactctagttatctgaaacttgtcaaattaggacatactgtccctttcaacatctcacttttaaaaacttatcaaaatcttacctattgtgagcaaaacttgccattcaacactttattgtcttcttcaattgaaagctgtaactacaaaagggcagatattcatgtcacggcaaagctacagctctaaaaccgccacagctaccgaagcttggaatcaatccacgacaaaacgttttcagcatcatgccattcatcacaccagttcttagcaaatgcttgtctatgtggcaagaggccagcaaaatctttcatgactgctttcaaggaggctgaaaggaagaatctggattcacagtaagataactaaggggcagtgaaagactacatctctcgttcttcttcaccttggtccttttgatttcttctacattctacaaatccctgaattttaccttttcacacgcaaatgctaatatatgtgtttttttttaatggaagctttctaatatggcttcattgacgtctacattttgtagtacgaaaaacacaagagaaattgaagtttacttactgtcaccttaacagtacatgaataaatgccctcctaatccataacacatccataaatgcgctaataacatattaagcatacaaaagccacatttaaagttgaacacattcttcccaatgtattttataactgaaaattcattcaagagatcaaaaatcaaatgttaagacttacgtccaaacgacaaaataacttgaaagtttaatggaaccattacacacaggtaatcaatgcccctccaaaacgcatagaatagagaaaaaatagcaaggcctgttgcaagatccaacttgttaaataatacactcccctcatttataatcggccaacatccgcttgagaaatacctgttctgccttctctgtggcagatattccaatagagctcttataacattttatacctgtctgtgggacagagactagagaagtcacacgctctatttcccagcctcccttccaggtcgagtcatgtgactaagacccggccaatgagacggaagcttaagcgacctggcaccaccccttcctcatttctttttcttccttcctggagcagctactgtgagatcatgaggcaacaatcatgaggacacggctaagaagacagcagagatgaggattcctgacacggcagagccaccgaacaacctcaaagctgcttttcttcaggtgagacaagttgcttcttagtgaagctgttaattccatctaaaaagagtcaaaagtgaataccaaatgcgagaacataatttgatgaatttcatcctaattaaacaaacgcattcacattctgcctgcctgttactgaacacttctttaaaacggttctcttcacgaacacaaagaagggaaacaacagatgggggtctaattgagggtgcagggtaggaggagggagaggagcagaaaacaataacttgggtgctgggcttaatacttgggtgatgaaatcatctgtacaataaactatttattgtacaagaatctgtacaataaactctgtgacatgagtttacctatataacaaacctttacatgtacccctgaacctaaaagttcaaaataaaataaaatggcaaaagtaaatggaaatattttgttctgatactacctctgccatccctcgatacgtacgtacacatgttcctcccttgcgctgcagtaatcacttttaatgtcactagctcagcagaaagaattctgtctttagcgtactgaattgccttcactggagtcaagaaggaaattaacctgtgaggttcaaatggcactcttcatagcaattaatacaagaatttccagcttcatagaaaaactgaatgctaagtggcagggaatatttcttagcaaagtcttttccctccactaactcattataaaaatagaactaatatgttgaggtagaattccgaaatagaccgagtttaatactttggtaaaaagactattgctgacccttctccatgtcagtgacgtcatcactggacttcttagattttcatctgtgcctaatgtcctgcaacatcacgcacagttcctgacaaattcactcttttcctcctctcccctgtttaaagaggaaagataacctcgatccaacaacacgctttgccagtgatggataccacccagtaataatatatcagagtgcccagtgccctctgcgtgggatcaatgagaaagcttattctggccggatctctacaatgaccagcccccgtcccaccacattctatgctcagaaatactacaactcctttgtttccttgaaggagcccttcctcaagcccctcaaggtttttacatgctgttttctctgtcggaaacactttgtttcttagtaaattctccatttcctgaggacccaacttaaaaggcacttctactggaggacctggattaaaggtacctccacctgctgagagctgcttgggcacaagtccacaccctgcattattaactggtgctctgtctccttctgttaaacagtgggctgtgtgaaggcagggtccatgtgggacttagtcccagtcatactttcagcacctaccattatgcctggtacacagtactcatctaacgggtacttctttatgaaacgaatgaattaatctgtaatgtgaaagacagtctagaagcaagggaaaggctggaggcacagaccaaatactaagctcttcagaaagcccagtcaacatcttaggctggattatacaaaactgttcctatttggctacttttgacttattatacaaaagtgttcatatttggccactttttacctattaattttttgtgtgtggttttttaaatagagacagggtctcattaactctccagggctggtctcaaactcctagccttaagtgattctcttcccttggcctcccaaagtactgggattataggtgtgagccagtggcaccagccaggaagagcagtttcaatgcttcaacatgataatgcctggactagggtaatggcaggtggtaaaaacaaatcaagatttcaaatgatggagtcttagagttttcaaccaattgattgtggataaatcaggacaagtaatgattcaaaggtgaggtttggccagacgtggtagctcatgtctgtaatcccagcactttgggaggctgaggcaggcgaattgcctgaggtcaggagttccagaccagtatggccaacatggtgaaaccccatctctattaaaaatacaaagaaattagccgggtatggtggtgggcacctgtaatcccagctactcgggaggctgaggcagcagaattgcttgaacctgggaggcggaggttgcagtgggcccagacagcaccagtgcactccagcctaggcaacagagcgagactccatctaaaacaaagcaacaaaaaaacaacaaaaaccaaaggtggggtttgatgaccagacacatggtgtcatgaaaagaaacagataattcatgagtattaactgaatttaggaggtaaaaaaataaggagacaaatcatttagataagatgaatttccaagcagagtaatacactgagggttttcaaatcttcagccagaaattcacagatttggaggctaaggggaacctggaagtcatctcttgtggttcccttattttgtagccgtgtgaggttaggtgcacagggctattcacttggtcaccagcagaatcaaggctacaatccaggcctcttgggatccaggtcaacaccactgcactgaggcaaccaacaccacttccttcactaaggataccaacccaagttactgctgacagtccattcagataagagtcaccatgacggcatgaattacccacttgacggacgatttctcggacgttaaaatgacataacatggataagcccatcaaagactgatattgggagtaagcagaattatattccttacatgattttaaaaagcctccaacacacaaaacgcttcctccatccctgctattccttggatctaacaaaattacagcaaaatttgcagctggaaaatatgtacgccaaaaattctaaatagaagtcccaggttttagtcctatctctggcacttactgtgtgcctctgggcaagcgaattcacttctctgggcctcagacttcctggtataagacagattagatcacctctatgtgaactctagctcaaaaaattatgactgcaaataaacagaaaatagttttacgtaagtttagaaaataaaatgtgtccaatacatcactatcaactaaaccctggtaatagaagccttgtgtcgtttgcttacgctgtcttggaaagctatctgcttcacaacaacactacagacaacttagaatgtctactactagagcactggttaagtaaatcatgacttacccaataatggaatgttacagaactattttttttaatgaggtagataaacatgtgatcacatgcaaatctaaaacacattaactttaaaaaggtatagaatatatagtacgcttttatttctgtataacaaaaaagaataaaaaagacctgcatagatttacatgtgactggaaacgtgcaagaacactatgcaagcagctgagagcggctgtctccacggagagcagacagggactctgggtaagagagaggcttgcctaggactgcacaaccttccatactgtttgatttttaacttggagcgtggattacagtatttttaaaagaactctttaaaattaaaagctatttggagctactttagatcagacaaattattgcaaatatagggcaccctttgttatttttcccccctattaatttgttcagttggaagggctgcagcggccctgagctgggagaggagggccactgctgacctcctcctcgctgcctccccccatttaccgtcagctcagactgaaagggagaggctggcaaaatcaaatgacaggtcaaggggagttatgaaacacgagagagaggtgctggaaaaaatgagaattctcccacagagaagggagatgcctctgggaaaactaaaaatagtcagctgaaaacaaatcaccagggacagagatgagccacgtggaaaataagaaacacgaggggtcacgtgcacatgaagcagaaacaaaaatctatttacatcctcatcaaacattcctgtgacacctaacgctattcagcccaaaacaaatataaaaacaccccagctaacatattttacagaataaaactgatttaatttactgtagctgtaaaatcatctaggacaaaagtagcaacataggccaacccaatgccctaaaagtgagcagacaggtcaccacgtgcctaaaatatatactaaatttattttcatcttaggcaccgaaaataataagcagatacaaacataaacctcaggggaagtattttgagactgcacacacttttattatgaagattggaaaactagatttgtgattcacttactacttccccataaccattaggatgttttctgtcagaagtgtttagtatacagaaatcttttagcatattaaaattaactgtcaaatctgactgagaaactatccaatgaaaaacgatgggaaccttctcatctacacaggcgaacaggaaatattcttctaaatttacctgtgtcctatttcccaaacactggaactaaaatataatttaacaggtgctgattttcacacatttggctggtgatggagaaaagagctagggaacaccaaggcaacaattctgccttccatcaacacaaacaacacaatctgctgccaaaagtaaaagtactatgcacttgtgctgaagcaacagaaaacaatttttaaattaagcctcatctctcattagagagagcttttttcctccaattatctgtctccttggaaaaacctctgataaacatctgcaaattaatgaagacatcccccgtgcaacactaaacagagatctatgcgagacagacctgtgtggaaaacaacagtgcttctcctaaaccctgaaggaagtcgaaggtttcgaagcaatcctttggccgtcagtcgtatgtgaatggtggataaggagaatttgggagacaacaacatgtcttcggagcaggtggcgagatttcacagaagaggcaatttccatggactgtcacatactgtctttttaaactcagtactcttcaaggccaagaaatacagtcagaggaaagatgcctacacagcaaatgtcattccaccagagaggcatagaagaaaaaaatcccccagggctggccaagtgtttctggcttccgttttcactttcagatgttgccaaaatgatgctcttcctctgaatacaatctccctcctgcaggtctagaagctgcctctgaaccacatcacactgtgcatgcttgtggagttgttatggttttcatccgagatggtaaaggggaggagaaagtgggtggtctcaggagctttacagaacaaccaataatgtcacagatcctgtaaccacttgaaagatcgctaggggaaattaactacttcaagtgcctaatgtttctttcataattagaaaaaaattaggatttcctgaaagtaaactgtgtcctgattttaacatttttcactccttatattcacaatgataacatgagcattttttctctagatattttacatgtaaactacatttaaacctggtattttggaaaagttttttttttaaagacttcaggcaataaatgttctcaactacaatatttaagaaaatttctattctaatatattaatgacagattgtcaaaaggttaaagttcaactttaattcccacatgctgaggacctcacaaataatcaacagtaaaagattaatacggtttctctatcagatgtaatatcagagttccagaagaatagtccatcagataggcatattctaaagactacatttattgcatgagtaattgcatttatagaacatcatgtggtctcttatagtggtctttcaagactaggagtgtgaggagggcacagttatgaatatcttttgccagttatctactaatttttatttcagtagagtggcttgtaaaagtatgttaaaacatgatagcaaaaccaaaagaacttgaaaaacaaagatatggttataagaattaacaacaacaatatgcccacttaagctaattccattaaaccacgaatagcctgagctcttaacatttttaaaaatgttataaacaaaacaatgttttaaaaatgtcctatgcctgtttccaagatttcctagaaaataagactcagaaataaatgcagaattgttaccataaataacactattaagtgctattaaaactagcaggaagcagttcttttagaaattctatagagtagggtatgaagcagggaagagagagggaggaagagaaaatttaaataagttctcttccctcaagccccctccctcttcactcaagcccccaacttgccattttagaggttgtcagcaagagagacagacccaataacctgtccagggttcctgtgagaaagatacacctagttcatacactgacgaaaaacctgctacatacattgcaccacagcaactgaagctaaatgatcaaggaattaaaatcaaggccagctgcttctaggtgttgccttttacttcatcccagtttattattaaaaaacctgaacaccttttccttccagattctacatactaaaaatataccagaaccttttcctctacctcccaaaaccttgtaaaaaccaagaaaccaatcagcattaaaaacaaacagaagaacagagtcaaattttgccatgattaaaaacagacatgccaccactccatatagtaggaggtggtttttctttcttttggttgtgtttgttgtttcttcagtaacagcaaattctaaattatccttttttgtttgtttttgtttgttttttgagatggagtttcactcttgttgcccaggctggagtgtaatggcgcagtctctgctcactgcaatctctgcctcccgggttcaagtgattctcctgcctcagcctccgtagatgggattacaggtgcccgccaccatgcctggctaatttttgtatttttagtagagatgagttttcaccatgttggccaggctcgtctcgaactcctgacctcaggtgatccacacacctcggcctcccaagtgctgggattacaggggtgagccaccacgcccagccttaaattatccttgttaaaagggaagttctttagactccctaaaagaagaaattaccatctaatcatcgattaatcagattcattaacatttttacttgaattacattaagctataaccacacatattgaaaataaacattgttaatgatatctcttaacagcagagcaagaagctgcaggaataaactaaattcagttctttcccaaacatagtctgcctcctggtggccgtgcagcacaagtgcaccaaagcaagggagctgccttggcagtccataaacaaatggccatcgcttacaatctactgctccaagcactctcttacacactttacgtttgctcatttaaataactggataagcaattactttcaggtcacaactatttttatactatatatgcctctggggggagccaagataaaaaattggttccaaaaaattctttgattatttgatcatctgttaccagttaggaactccatattttctgaaattgaacgaatgtgagaagtacctaaaaaaagcatctttgttatttttaaaagtcttaatttaagaggaaaagataggcatcaccaaggacagtagaggaaaaaataaggaaattttagtgcctaaagtacaacagtttgtagttgtaaaagttagctatgagtctttatgggccgggcgcggtggtgagattacatgcctgtaatctcagcactttgggaggccaaggcaggtgggatcacctgaggtcagaagttcaagaccagcctggccaacatggtgaaaccccgtctctactaaaaacacaaaaaattagctgggcatggtgacaggggcctgtaatcccagctactcaggaagctgaggcaggagaaccgcttgaatctgggagatggaggttgcaatcagcagagattgtgccattgcactccagcctgggcaataagagcaaaactcctcaaaaaaaaaaaaaagatgagtctttatgaagcagagcctgtgttaggatgtcagtggaaaacaaaaacatgatttaaaattttatgcaatgtaggatctcaacattaaacaaaaacgattaagtatattggagcaaacatgccagaatgtcaccaatgctctgggaggtagaagagggaggatttctattttttctttattatatgtttttgtattttcctaattttttttttcaaaaatcatgcagccagaaaaaaattaaaaagtttaagtgttagaataattttatagaaagcctacaaaatgagccgagttttcataatgacacaaagaaaaataaacgatgtgtaaagtctatactaaggcttaaataacaaaagaggatgatacagaatgtttcataagtcagtatgttgtaatatcacagtatattcaaacaaacagaaattccactggtctgcatagaaatgtgtttttttaaatcagtgatttagaaaacaatgatgtcatgattctagacaagaatctagcataatctgtatggggtgcttagatgctacaaaatgccttcaatttatctgttattgtttgttgttgttaatgatcataaagaatgaggaagaagattaaaatttaaaccaagtgacttgtgtggagattcaagcatctctatccaaccaatcttccttagcctaatatggaatattaatctttatatttatctccttactttccctaacacagcattaattgcaacattttcttcattttactcctcacagtctttaatgtagtaagttcaattctctattccagttgtagaaacttcaacttaaggcccaatttttccacactatcctcttcctcagtacgaagataaattgtaattatcaaaaaattaacacaaagcaattagaaaaacaatcaacttccacccacctgtaagatgataagctctcaaagaacagtgacattgccttttattttgcaataagcaaaataagagtttaaattaaaagcagtaatgcttttaattcatgtacaatgtttgtttttaaaaaacaaaacctcatatgttcatcgtagaattttttttttgagacggaacctcggtctgtcgccaaggctggagtgcagtggcgtgatctcggctcactgcaagctccacctctcgggttcaagtgattctcctgcctcagcctcctgagtagctgggactacaggcgcccgccaccacgcctgactaattttttttgtatttttagtagagacagggtttcaccgtgttagccaggatggtctcaatctcctgaccttgtgatccacctgctttggcctcccaaagtgctgggattacaagcgtgagccaccgcacccggccagaattttcttttcaatttaaattacttacacatcagactgctctccaatttgtttttaaacttaacataagcttaataaacttattaaacttaaaaatttcacacttatctttccatgggattaaataagcatttatattgttattttaatggcttcaaaaatgtctttaaaatgtcaacgaacttaattcctgtaaggtatataggttgtttccaattttcccccattgtaaacaattctgaaaagcagtcaataagtaaataaattactttcctaggaccaattctgaaaaacagaattcccgggtggaaggtgtttgctctctgctacagctgctgtaatttaccaaggagctgtacatatgagtgctgtttcttattcttcgccagtaccaggtgctaacattaagaaataagcaagaactgagagcacattattttaactcatatttggtaaacatttttcatatattccttagtccttcatatatttcttttctgtccatccacttatttttccctttctttttgtttagtttttttaattgtggcaagaacacttaatgagatctaccttctcaacaaaattttaaaagaacaatataatattgttaactgtaggcacaatgctgtaacaaacatctcgaaaaccttttcgcccttgcataacaaaccttgtaccattgaacatcaagttcccattccctggcaaccaccactctactctgtttctgactttgactatgttagatgcctcctataagtggaatcatacagtatttgccccatgactggtttatttcacttagcatagtgtcctccagctttatctgtatcacagcatatggcaggactttcttctttttaaaggctgcataatactccagtgcacatatatgccatatttgctttatcctatggacacatttaggttgttcccacatcctggctatcataatgtggcaatgaccattgttgcagggagtcagggaccccgaatggagggaccggctggagccacggcagaggaaacataaattgtgacgatttcatggacatttatcacttctctaaaaatactcttataatttcttacgcctgtcctactttaatctcttaatcctgttatctttgtaagctgaggatgtacgtcacctcaggaccctgtgatgattgcattaactgaacaatctgattgcaaaatgtttatttgaacaatatgaaatcagtgcaccttgaaaatgaacacaataacagtgattttagggaacaagggaagacaaccataaggtctgactgcctgcgcggtcgggcagaatacagccatatttttcttcttgcagagagcctataaatggacgtgcgagtaggagagatatcgttaaattcttttcctagcaaggaatataatattaagaccctaggaaaagaattgcattcctgggggtaggtctataaacggccgctctgggagtgtctgtcctatgcggtggagatagcttggccgggtgcggtggctcacgcctgtgatcgcagcactttgggaggctgtggcgggcagatcacgaggtcaggagatcgagaccatcctggttaacatggtgaaaccccgtctctactagaaatgtaaaaactttgcctagcgtggtggtgcgcacctgtagtcccagttagtagtcccaggcaggagaatggcgtgaacctgggaggcagagcttgcagtgagccgagatcgcgccactgcaccgcagcctgggtgacagagccagactctgtctcaaaaaaaaaaaaaaaaggactgagagagatacgccctggtctcctagtctcctgcagtaccctcaggcttactaggattgggaaacaccaaccctggtaaatttgaggtcagaccggttctctgctctcaaatcctgttttctgtaaagatatttatcaagacaatacgtgcactgctgaacatagacccttatcaggagtttctgattttgctctggtcctgtttcctcagaagcatgtaatctttgctctgcctttttccctttgaggcatgtgatctttgtgacgtactccctgttcatacaccctctccccttttcaaatccctaataaaatcttgctggtttcgcggcttaggtggacatcacggacctaccaatatgatgtcacccctggaggcccagctgtaaaattcctctctttgtactctttctctttatttctcagaccggccaacacttacaggaaacaaaaataacctacattgaaatattgggggcgacagaccatgggaatgcaagtatctcttcaacatcctgatttcaattattttggtaaataacgccttatcagacgtatggtttgcaaatgttttctcctatctcataggctgccttttcatgctattaaatgactgctttgctctgcagatttttaatctgatgtactccaacctgtctatttttgcttttgttacctgggcttttggtgtcataccaagaaaaatgacatgaagttttgccccatgttttgtttgaggtgttttatagtttcagatcttatatttaagtctttaatccatctcgagttgatttttgtgtactgtgtgagataagggtccaatttcattattttgcttgtggatgtccagttttcccagtactatctacaaaaagactatcctttccctattgtgtattcttggcacacttgctgaagattagctaaccgtatatgcacggatttatttctagactattttattccatcggtctatgtttctatatttgtgccagtaccatactcttttaattactgtgtgttgtaatatactttaaaatcaggaactgtgatgcctccagctttgttctttgtcaagattgttttggctatttgcagtcctctgtcattctatatgacttttgggattgttttttctatttctttaaaaaaatgacactgggattttgatagggattgcactgaatctgtagatctctttgggtggtatgtccatttagcttctattatagagttgtctttatcttgctgatttgacagagctctacacagagtatgtgctaatataacctcagtttgttctttgcttataaatactgtttctaatgatttttattctttttattttttttgagacggagtcttgctctgtcacccaggctggagtgcggtggtgcaatctcagctcactgcaacctctgcctcctgggttcaacgattcttctgcctcagcctcatgagtgctgggactacaagtgtgcacaaccacgtgcagctaatttttttgtatttttggtagagatggggtctcagtacgttgcccaagctggtcttgaactcctggcctcaagcaatccacctgtcttggccccccaaagtgttgggattacaggcgtgagccaccatgcacagcctgtttctaaggttttttaaagcttttgttgtcctaattattaatcgtttctattatactagtgttcctggaaagatcttttctacttaagtctatattcttagtgttttaattactttgtgtgtttaaaactaatttatctgaaatactttgtatatatgtgaaaaagatctagctcctgctaaaaaggtagtcactgtctcaagaagatttactaaatgatccactcctcacaacccccaacaccaatttgaaacaaaaatgtatcccatatgaaaagagcatctgtgttttaagtatagggggaaagttatgttaatcataaaacaacagtgaaaaaacagccttctctctactctcaccagaagaaaccctggcagcctcggcatcacctcatcagcaggtttgcaacttgcaaccacttcccagcacttggcaaaagaaggcaagaaagccgccctgttctcctgtgatgtctttactaagtaactgcggaaggaccagtgcattttctaccttccaaggcagacactctggcacctgagagtgatgatcttgtgtaaaccaatcagggtactggataaatacagctctgatgcctctggtatgccagtggctttagtgtatggtagaaccaaggtaataatagtattctgtggtatgtgtgacatcttccttatcagcagtaagccaagattttttttagagtcaatatcaactacaatcttgcagcgtcataacgtttaaataaattacaacagttagaccccaagaggttggttcttgactttaagcagtctttcctgcttgctttagagatttaaaataattcaacttcctggaaaagaaccctaaaaataagcccctagaattataaaaacaatgtaaaagatcgccatcattaccgttcctagcagctgacttaactattatttgagaaccttttataaaacaattctatgatgtcatattattgcctttctgggaattatttccccaatattcccatgtctccaaacgagaaatttgagacttggagaggcttagcaactagcccaaggtcaggacacaaatagaaagcagcaggacgaaggtttaaaccaacatcccgtgccttaaaagttcgttctcctcctgcttttctacattgtcttatgagataatgtaatttctttaattgataaaggtcaagctaaaacaatgatgtaacattttaaactattatgttagtcaaaaaaatttaaaaataatatccaatgttgacccaaggtatgatgaagccaggtgtcttttatgtcaaccacggtataaaatgatatgaagcttttggaaaacaatttggctatttgagtgaagtgactgtaaatgggtacatattgtgatttcctgatactacttttaataatctatcacaagaaattgaaagttgaaagtgctaattgtatagatgttcatcatagaatcatttatgaatgtgatacagaagcaccctaaatattcaaaagtagttaaatgttactgtatctgctaaatgtaaaagtgattactatatgttaaatgacaaagcaggatatacacttatctaaatttcatttaaaacgacaaattttaaaaagctgaagggtgatttctaaactacatgctaaactttttgaagtttggcaaactgctataattaaaagtgattattttactagaactaaggaatatgaagttggtcaactcaactgtaatctccaccactacttacagctttaaaataaaaatatctcaaagccatagtacaacgattaaaaatttacactcagaggaacatgtttatgtgtggaggcaatgtcttctgtatcagctaaaatatgactcatttccagcagaatatgaaaaaagtcaaggtgattttcagtcacagaatatcacagtagggagaaatctagaaatccaccctttcagttacatagaaaactattatcaaagaggttcaatgatccacccaaagtcactggcttttcagcatcatttttcagcatcaaagtcgtctttccaaagcaaacacactttgttgtggtcctctgtccacacagtaacttttcctcactaggctcctcataataccaggttagtcttaagtcatgataataactaaccatcgagaagaacctgggaaagtcatgcttatggtttcgggaaaatacagaggcctaccacacaatctagattaagctgcaatgttgaccccttagaatacattctatatatacagagtcatctatagattcaatgtaacagaaattattagaattggaattattagattacattcctaaaacctcacctgacttcattacagagattgacaagctgatcctaaaattcatacagaaaatcaagggacccagaatagccataactatcttgaaaaagaaagacgttgaatgactcacatcctgatttcaaaacttactaatcaagacagtgtagcactggcaaaggtaacatataaatgcaaagaacacaatttagaaatcagaaataaaccctcacattcttaaccaattatttttaacaaaggtgccaaggcatttaaatgggggaaatacatgtcttcaacacctggatgtccatgtgcaaaaaagaattagaccttctatctcataccatataaaaatgtaactcaaaatgaatcagaaacctaactataacagctagaatagcaaaaaaaacttaaatgaaaacacaggcttaaatcttcacaaccttggattaggcaactgtttctgagatacaataccaaaagcagaagcaacaaaagaaaaaaagttgataaagtggaccttgtcaaaatttaaaacgtttatgtttccaaggacattatcaagaaagtgaaaacacacccaagaattgggagaaaatatttgcaaatgataactctgacaagggtctaatatcagactatacaagaactcctacaattcaacaataaaaatgacccagtttaaaactggcaaatgatttgaatagacacttctccaaagaagatatacaaatggccagtaagcacacgaaatgacactcaatgtcactggctgtcagaatgcaaattgaaacaacaatgaggtatcacttcatacccagtagggatagctataataaaaaagacagacaaagccaagtgttgacaaggctgtggagaaacaggattcttcatacactcctggtgaggatataaagtggtccagccactttggaaaacagcctggaggtttcttaaactgttaaacacagagctaccaattgagccagttttctgataatggttaactaatttttaaacaaagccattccatagaatattagctatcttttttccccagatattaggatgtaccagaaacttaaaaggaaataaaagcctaaatgtgtacagcagagtttcttctgcatttttaccctataaaggctttagtaaccacatatattcacactcagcatcctggggatctttagaacttagatcattctgcatggctgtcttcctagctttaagagcctacaaaaggttacgaattctgagatagctgggcgcagtgactcacgcctgtaatcccagcactttcggaggccgaggcgggcggatcacgaggtcagaagatcgagaccatcctggctaacacggtgaaaccccatctctagtaaaaatacaaaaaattagccgggcatggtggcaggcgtctgtagtcccagctacgcgggaggctaaggcaggagaacggcgtgaaccagggaggcagagcttgcagtgagcagacatcgcgccactgcactccagcctgggcgacagagcaagactctgcctcaaaaaaaaaaaaagaaaaagaattctgagataatttccccacacttccctgcttattacactgaggaaactgaatacacctgatggggcatcaaggatatttgttattcatgttattcatgatgtaatgttatcccaccctgttttctttacacaacaggctcagaaatttatacctcttgcccaggtttccctcacatgacagccttcaatccggacctctcttctaggacaagacaaccctccttcctagaactcagtgcatttgtgattcatgtctatttgagcaggttttttattttatttttttaactatcctattagctctccagagacaaggcccctgctcattcttcgctcaggactgcatccttaacacctgacactcacaatgtgtgaacaaactgtagtcaacattctgtaacattacatgcatacctgggagatatatatcaccccataagacacatgacataataaggcaaatcacaaaaattgtctggtttctcagtgcatataaaacttatattaacactacactatagtctagtgtgcaacagcattatgtctaaaaaaatatataccttaatttgccaggcgtggtggctcacacctgtaatcccatcagtttgggaggccgaggcaggtggatcatgaagtcaggagatggagaccatctggctaacacggtgaaaccccgtctctactaaaaatacaaaaaattagccgggcatggtggcgagcacctgtagtcccagctactcgggaggctgaggcaggagaatggcgtgaacccgggaggcagagcttgcagcgagcagagatcatgccactgcactccagcctgggcgacagagcaagactctgtctcaaaaaaaaaaaacaccttaatttaaaaatatttcattgctaaaaaatgctaaagatcatctgagccttcagtgagcaggaattattttgctggtggaacatcttgcctcaatgttggtggctgctgactgactgattagggtagtggttgctgaaggtttgggtggctgtggcaatttaaagtaagacagcaatgaagtttgcgacatcaattgactctttcatgaaagatttctttgtagcacgtgatgctgtttcatagcattttacccacagcagagagtctttcaaaattggagtcaatcctctcaaaccctgccactgctttaagtttatggaatattcggactcctttgtcatttcaacagtgttcacatcatctttaccaggagtagattccatctcaagaagatactttatttgcttattcataagaagcaactcctcatctgctcaaattttaccagagatcaacagcaatgcagtcacaccttaggcttcacttctcattctagttctcatcctatttctaccacatctgcagtgacttcctccactgaagcactgaacccctcaaagtcatccatgacggttaggtcagcttcttccaaactcctattcacgttggtgctctgacctcctcccatgaatcacgaatgttcttaatggcatctagaagagcaaacccttttcagaaggttttcaactgactttgccccgttccatcagaggaatcagtatctagggcagctacagtcttacacaatgtacttcttaaatagtaagacctgaaagtcaaaattactccttgatccatgggctgcaaagtggctgctatgttagcaggtgtgaaaacatccatcttcctgtactatactcttgtactatatattactatgtaatacactatactatactccatcagagttcttgggtgaccaggtgcactgtcagtcggcagtagtattttgaaagacatctcttgagttgtaggtcttaacaatgggcttaatattcagcaaaccatactgtaaacaaatacgctgtcatccaggctttgttgtttcatttatagagcacaggcagagtagatttaacgtaattcttaagggccctagaattttcagaatggtaagtgaacgtcagcttcaacttaaaattaccagaagtattagcttctaataagacagcttgtcatctgaagccaggcactgacttctcctgtttacctgtgcaagtcctaaacagcatcttctttcaatatgaggctgtttcacctacactgaatgtctgttgttttgtgtagccacctttatcaaatgatcccagctagatcttctggatgactcgctgtagcttctacatcagcacttgctgcttcgccctgtactttcatgttatgaagagttaccttaaacctcatgaaccaacctctgctagcttccagcttttttttttctgcagctccctcacctctctcagccttcatacaattaaagagagttagggtctcactctggattaggctttggccgaagtgaaagttgcagctggcttaatcttctggtcagaccactcagactttctctctgccgggagtctgttttgctttcttatttgagtgttcactagaggagcacttttaattttcttcaagaacttttcctttccatttacaacttggctaactgcttggcacaagagacctggcttctgaattatcctggctttcaatgtgccctcctcattaaactcaatcatttctatcttttgatttaaagtgagagacatgcaacttttctttcacttgaatattcagaggtcattatagggctattaattggttactttcaatattattgtgtctcagggaataaggaagaccaagaaaagggagagagatggaagagggaccagtcagtggagcacttgaaatgcaaacgtatcagctgtgttcactgtcttagatgagcatggtccatggtgtcccaaaacaatcacaacagtaacatggaagatcactgatcgcagatcaccgtaaaagatataataataatgaaaaagcttgaaatagtgtgagaattaccaaaatgtaacacacagacatgaagtgagcaactgctgttggaaaaatgatgctggtagagttgcaaaaagcacagtatttgcaaggctccagaaaatgagcgatgcttgtaccttcgtttcttctgatttgctcttctaatctgccatggatttagaaggcacataactgttttatcactgtatataaaataagacaatgtaggcagtgtacaggagaccttatctatctagagagatcaatccatctatctttttttttttgagacagggtctcactgtgtcacccaggctggagtgcagtggtgtaatctacgctcaatgccacctctgcctcccaggttcaagcaattatcctgcctcagcctcctgagtggctgggactccaggagcgtaccaccacgtccggcaaacttttttgtatttttagtagagatggggtttcaccatgttggccaggctggtcttgaactcctgacctcaagtgatccacccaccttggcctcccaaagtgctgggattacaggtgtgagccactgggcccagcctatctgtcggtctgtctgtctgtccatccatccatccatccaaagtataggaatcgcagtgaagatattttgtgaaatcttttatgggttcttgagagacataaagttttggattctcagctgtggttcaaatagtggaggctgcaggctatcttgggaatgttaagtccagtgaaagtgtgaaaaaaaaaacataaaaatataggctgctgaactgggaaaaggtgctaaaaccaaatattgagaccacttaaaaattaaggaatatccaatttcaaaatagcattgatcttgggggaagtacattttccatttcatttagaccacattaacaaaatcattttttaaaagactataactatctattagtaatacaatgtcctttcatgcattagatggccagtcatgcttaccgtattttaatgctatgcgacccgtcataaaaagttaggtttacacctcaaattggaaattctacttataagcacaccagtaaaaaatcactgtaaatacttgtagtaacataactttacaaaaagattctttttatcgccatccataaagtggtcactcacctgcattaagagctgtaaataaattttttctcgaaggacctaagatataaaagaaacatgtaaaatacatatgttttatttgacatatcacataaaaacaaaccatgttgataagaattattttcaaaaacaatcaatcgctacatttcaggttcccggtgggaaatatcaccgagattcaaccaacttttgtcaagtgcattttaaatataaggtgatatttcacataacatcaaaatgtttaagtatgatatgaagtcaccacaaattaaataggaccagttttaaaaggaaaagccgcagtattttttcagtcaagaacagctgaagttcaagttttaacagtactgaattcacagactgtgcacatatgccattctgctgccgggagagcagaggccagacttcacgaaggacagtcactcccgtgtgctttccgaaactacccgtttctattcagctatgaagaaaaatagaagtttttcctccaaactgataaaatataaaatcaggaggggtaataggtacacagctgtaagtcactaaaagaaatctatgatgcttctacttaacatgaaatagttgtttctaggacataatcatctgcagataccagttagaacagctaccatgttctatctgaaattttacagagatgatgatctcttaaaatacgtggctgttatcaatggaaagcactgattcccacacaggtaaaactgttgcgacataacctatccattcaatagtgaggcattttagaattctgagtctcctgttctacaaagctgtccatggaatctcattctctgcaagttattttagtatcaaagttcaacagcgttaacttcattattgctgtgtggatcatggggctttatcatcatcaataaaaaaccacagttttccaacctgatgtcaactcagcaagaggtcatttggtgcctccgaaatttgattaactccctaggcaaatgacaacctgctgcacactgaagaattcaacccactcctaaaattcatgcctattttctcttcaattcagtacaaagaaaaggtattgacatacattaaccagcctcaaggtaccatattatcctttaaacacacacacagagagagagagagacatgttaaggaggatgctgtgacagagtaacacctctgagaaagttactaatagatattaacaatccaaagagtttcatgcaggttaacccagtaattcctccttctgggatatccacaagtaaccagaatctgaaacaatgaatcttgactcacatttgaagaggttcatctcagtattaataaaccccaataaaagtcagaagttgcccactataaactgaagtggacaaccatagaatagccatttaaagtgaagaagctctcctgatacactactaacttaataaaaagcaagatacagaagagtatattcattattacctcagttttgctggaataaaaacaaaacaacatatacatacagaggaaaaaagtcacaaggaaatgtgacagcaattgctggttgacagaattaaggaagactctttgtttctgtgttttccaaattctctaacataaatgtgggtctcattttataggtcaagtttctcactcacaattattcgctcaggctttagttaagcttcagttcactaagcacaaataatgctttttttttttttttttttttttttttttgagacagagtctcactctgtcacccaggcgggagtgcagtggcgcgatctcggctcactgcaacctctgcctcctgggttcaagcaattctcatgcctcagcctcatgagtagctgggactacaggtacacacgaccatgcccagctaatttttgtatttttagtagagatggggttttgccatgtcggccaggctggtctcaaactcctgacctcaagcaatccacctgtcttggcctcccaaagtgctgggattacaggcgtgagccaccgcatgtggcacaaagaaggcttctgatgtgctttggccccactgagacaaagctgcatgaaaacattgcacattaagtgtataccacatattttgtaaacctgaaaattacttttcataatcacagcaaataaaaagtgagggatatgagaaggaacagagataaagaacatttagaggaagaacaatgtcttagaccaaagacatgaagacacaagtacagtaataaacataaaacatctaccctgatgaaaagtaatcatgcatttctactcctttctcactattctagagcactgttttagaataatttaactcctgaagttttgctgtttctaccttatacctttgttctgcctgctgacttacacgtaatgatttttaactatagaacctaccaactgtcagaaaaacaatttcctcagtgcaaaaatgtattatatctcctttctcaacatatttgtaatcattgttgactataccataaacctaattgtcaaaatttaactttctacaagccaaggactttaagcgtcttgccctccctcttcaaaccacaatgaggactgtaccttttggaggagttttcatcaagtgaacatgagccctggataccaaaggcttcaaataaaaggatcctgaggaaccattctgaaatgctggttttggaggtttctcctcatatttgatgacagcggcattaccagctgtaataaaacagaaaagtacattttattgtatagataaacacagtttcgaccttccacatttattcctttgtccttgaaccaacaaatgctcaataagcacctacgacatgccagtcattactgaacattgggaatacaacatggataacaggtagcttgtgtctcagggatgcgaaataaaggctataatcagagtgaccacacatcctggttagcctggcacagtccaagcttatgcatcttgtccagttcagctttcatcccagataagagttggggaagaaataatacagccacttcatgctatgtaacaagaatgccccaggtgcagctaggaagagcacccatctccatggggacaaggaagaattcgcacagtcagctagttaatgacacaagaacagtaacatacagactccttggtagctataaggacacgctctggttcaaatccttgctcctacagcaaggagttaaaatgctaacttctgccctgaacaaaggaagtttgttccaaagtaaactttatgttttagctccaaagcaaaaacataaaagggaatcttacctcaataacaaaaaccatctttttatattatgtgtaaaaatttcccctccaccaatccagactggattttctactgtttgtttgtttgtttgtttgttttgagacggagtctcactctgtcgtccaggctggagtgcagtggcatgatctcggctcgctgcaagctccgcctcccgggttcacgccattctcctgcctcagcctcttgagtagctgggactacaggcgcccgcggccacacccggctcattttttctatttttagtggagacggggtttcactgtgttaggcaggatggtctcgatctcctgacctcgtgatctgcccgcctcagcctcccaaagtgctgggattacaggcgtgagccaccgcacctagcctgtttgtttccaaataatgatcaatatccaattctaggcacccaattctattctactattcaacgcttataaatttctttattaccaactatgatcccttttctcacttcactcacttagcaaagggttaagatacctaccttgtttacaaatgcattataaatgtgaagacagctagaaatttttcactaggctaacctattccaactgctacaatagtgcttatacacatcacattcaaactttgtacaggcgtgctattattttcccctaatccacacccaggccctgtacaatgagccatctgttcattgttctcgtgcccaaataacattcctaatattaggtcaaatcaacacagagctttccctcctgctgagaaaattctgtcaatttcctgtccttttttccaattctcaccttccctagaacctagagacttggcttttccaaagttgacaggaagctaatgggagtgacagtattaaagacaccgccattacaacattcaacagaaccctttttagatgttcatagaaaatggatattgggtttcaattagcattttagcttttgctgaatcaaatccaacaaagaaaattagacagtcttaaccatggaattataacaatctggattttagtcttacttttcttgaagccgtatttgattatattcagcaacaaataagtcacttattcatattttaaaaaattaaactgagttcaatttacagacctaatatgcaattgtatgattctaaattcatgcttttcttttctaaaatttagagacacaaaggcccacggttcacaaagagatcagtaaaaagattttcactaaagtaaaggacaggttcttcatgagggatggtactcctgtgtcccttgcctctctgtcacatgcaaaataggaggtggtgtgctggaaatcagctgtctcactgccacttttcagactcaatacaacactagatcaacccggcaccacacccatcatcagcttcataacacgcaacatgaagtcagaattcatactgcaaggataaaatgtctgcgtttgactcaggtacaaacacacatgcatttatattttatacatatttacatgaaagctatatatacaagatacatattcatatactctatgatcaacgattgtacctgctttctgctttactaatggcaggcacaacctgtactgagctgaacataattttatgactaacaatatctttctctcaatttctacttactgtactctaggctggcccactgctttccagtaaaccccaacttgaaggatgtataccaccatgagtcataatgctcttcaaatatttcccctgccctctatttctgttcctaacatggcaactgactgagtatcctgatgctatctaaattttccctcagccagagtcattatatccaaacaataaagtcctcagcggcaacaattccaatataagagatgcataatagtttccagcaatggaacaggatgtaaaatatcctagttctggtgctgacttgaccactgcctagctgtgctgaatcacctatctatgaataacaagggtctgaatatcgggtatgggaatagacagtgcattcgcccatatcgggtatgggaatagacagtgcatttgccttcacaactcactgtggtattcagtcccactgaggctggatgcatcctcagaatcatcctaaagacagtgttctagagagccatggacactaaacactgctggcttgaagagacaatacataaaatttttcatgtggccacctacttctcaacctgatctaatatgtagtttaaaactgcccctttgtcatctttggtcccaactgtctcaattatgccagaataacagattctctggaatctttatcttcatttccccatggccaaagtgtggttcaagtgaaataaaggagctggtgagtctaaaaggaaaaactaagggatattctcaggaaagcccaagcagaagacatgattttcctattagaaaagggcttctcatgctgggcacagtggctcacaactgtaatcacagaactttgggaagacaaggtgggcagatcacttgaggccaggagtttgagaccagcctggccaatatggcaaaaccctgtctctactgaaaatacaaatattagctggacgtggtggtaggcacctgtaatcccagctactcaggaggctgaggtgggagaactgcttgaacccaggaggcggaggttgcagtgagccgagatcgtgccactgcactccagcctgggcaacagagtgagactctgtctcaaaaaaaaagaaaagggcttctcattgtttcagacttttatctgcaaactaacattcatactacattctaacacctagtgaaaattcgcttttattacattatgtatatacacacagagccaacattctgttcatttcttgaattttatgtgaatcagtttaacactccccactgtgccagatcatctgcccacttggcttaaaatcaaagtactactgaaatctaaacttttgaatttcaaaagcaatatcactcaactatataataacaagaatgtctcacatataccctagaaaaacgtgaacagagaaagaacgagaacaaagttaacagtggtctggataatatttcctttttaaatagtccattcagaagtgcgtaagtactaacatgttttgtgatgtggagcctaatgaatctaccgcctgttcctcatcttagcctcacccatgacagacatcacgacttgaacacaaaactttccctctgaacctggaggcaccctgagaaaccactgacaccatcctacaggcgaattcttatccactaaccagtgttggccactaaccagtgttggcaggtgagacaatattcacttcccattcctgttgtgagagaagaaaaaaaacaaaaaacaaaaaactaagggtaaataagatccaccctattctttatcagcttaatcacttgaacaactcaaaacaccatcctgccaaacaatgaggccctgtcttattgcagtgaaaagggtcagaaatgtttgttgctgcaaggactttgaagatgacccagtcctcccttgtcattgatcagaggagagtatggaggctggaggctaagaaaagacaaagatagtccaacttaacatgagttagtaggaaaactacggtgggaccgggcgtggtggctcatgcctgtaatcccagcactctgggaggcagacgcaggcatatcacttgtggttaggagttcgagaccatcctggccaacatggtgaaaccccatctctactaaaaatacaaaaattagccgggcatgatggggcatgcctataatcccagctacttgggaggttcagacaggagaattgcttgaacccgggaggcagaggttgcagtgagctgagatcatgccactgcactccagcctgggcgacaagagcgaaactccatctaaaaaaaaaaaaaacaaaaaacaaaaaacaaactaaggtgggtccaaggttagtgcccttttctgcatgttacaccccactcagccagggctgtcagtgaaggtgaagggaaagaacactccatttcttttattcagtctccttctgttccttccatttccaggagaatgcaaatagctttggtctgcacctcttacatttcccctaccatctggctctcaaatataaacatggttttgtggccaaagtggaagaggaagtaatgtctttggaccttactttcctgctaacatcgcaaagttatacactctcccaagacccccttctaaattgcacaatagtccccaaatcttcaactctgttcatgacatacaatatatcatttatttttacccagttactttaatgatcttaaaaactggatattaggtatctgagtgtgaaagaccttataatctttaacctctataaatgagcacatttggtatagaaaccattgtgaaatgttttacactaatatccaaaaggatcaagatcgtaactttgaaattttctacacttaaaagaacacacacaaagaacctgctaaaattcccaaataagaacaatttattgccttacgtattttgatttggtcatttaaaaaatttagtaacattatttctataggatcccaaagttccgagaacccagtgctaattttacaacagcactgtgttatatcagaagttcttaaatgatgccactaaagatatcacatcacaaagaaacaagcagacaaagcgagaaaccaatatttgttaaagggattcaaatacttaagccagtataaatcagaacactgatcaaaagaggaagttaattcttaacatgaccacccattatcagaaacaggaaattttcagcgcgagatgattttttcatgttttgaggtagcctttaaaagtatacatgtttaatactttcagttacaacttaggaaaataaagatgtgatgtttccattttaattttagaaaagtatttttctacacttgcacaactaccagctacatacacacaaaaactagttatttcataagaaattaaaccatcaaaaagtctttgataataggataatttcatgtgccagaacattaacgatgctgctgaattatattaagagtgcaaaacacataaaagagacaacaaaattggtcctacacagaagcattcacatcttaaatatacatacaaaatgcccccaaatactaccattaccataaattacaagttacaaaaacagaagtcaagagatcctaaatcaatttattgaataaaaatttaagcatgcttacaaagaaaagaaaccagaaatcgtcgacctactttttttcccagtaaacgtggctaacaaaggaattatacaaaggctgtacgatcccacgaccagcagtgtcaataaggtagcatcatagtgcctctctgaaccagccggtggggtgagtgtagaattgataaagatttttgaagaaatatcagtttctgtacaactgcgaaatcctcctggtacagtcatttaaaaggatcaaagcaagcttaagcaggaaaaactgcagccatgttcactctcatatccctcatgcttgctcttagtgaattcgaatggagggaaaaaaaaaaaaatgcgtaagctccaaggcactacacaaaacagattaaaccagctagcaaatcaaactaagaaagagactcactgatttgaatgcttaatccgcaacaggaacacatcgccactagacaggctctgtgggtgtatggtaaacccctttgttaaaagacaaaaaggaatggacaaaagcactttacagcctccttaggagcatcagacacagtactgaaacggtggccaagtcaacatggatgtcgatggaaaacacggggctgtggcactacagactgtgtctgcttcaagtgccacaaattctgttgccacaacagtttttctagagcatgttggtgattctgttttggcagtttgtctttaaaattgctttgcaagacaaagagagcttaaaataatacacgtgtgaattaccttttcaaattcagagttccctcttacatgcaagcctgattttgtgccacaccttcaaaattccaacagtaaagctggtaacaatcctgtttaattgcaagtcacatatcccagtattcctgaagtgccagggtatgcagctacttactctcatatgagtccagctactgctgctaggtgacccgtcggaaatgtgctcattaattcggtcattaattcaatgccttctctacaaaaaatgcattctcaattccctcacatagctgctgtgtgattttagaccagtgacaacatctctgagcctcaatcaccttctatataaatatcagggtaacagcagaagttacctgagagaaaaaaataaaagcaaatatggacatcctaaagtactgctccacacccagaggagcctcatgagcattattacactttgtccccaactcctcacccaaaagaagaaactgatctgtcaaactgaagagatcagttcgccactcctctccacacccttgtgtctggttttattggtattctcatcatccatgaaaataccttctttttctcctcaactattttttagaataagggccatttcttttatatcctgtgctcctcactgcgcctatcatggtgtctgtgcacagcgggcactccaagatggtttaaatttatgaattatttcgtggggaagtataaaaaaggaaatgagaaaataagaaccaagtccaaatacatctttggaatgaaagaggtatctcagtaaattcactcatttatacacagaaaatagaactcacgttaactgaaaactttaacaaaattctcctgagtttcaattttttagaattaggattcaagttatattagtcctattacacaaaatctagcatccaaagattccacaggagatagtcttttgcaaagtaaatgaaactgaaataatctttttttctgattccagttagagtccaaatcccctgggttgctactcttaaacctccaaaacaccatcacttcagacgatgcactttcgaatccttcatgcaaaaatatactttaacacataattatttcaagagtgtttttcaaagaattttttttctgccaaactttcagagcaactccaaggaagcagtatgcctatttttcctgaaaccccagaaacaaaaattctaattatttgcagagcattagtttttcttgtaatgactgtttccacaacccccgaagtgtgatataaagtcgacttacaattgttgctgtaagtgctcagctcactgtgggtgctggctattgagggggtgcttcctgtcctccgcagcgcaggacttttcaaagatgctttggatttaggaagtggtctaggcaaattcacccatgacgactgtgcagttttcaaggatgtaggctttccttggggtttaaaaaaaacaaaaagtttccagtgctattcatcccgaaagctggcactttttaagcctgtaaactcaaacttctgcactaacaacaaagtcaaaacacaaaatgaatgttcacaatcatgtaacttcagatgaaagatgaaagcttcacgcagacatgtttatttttgatcatttagaggcaagagagcagaaatgatgaggcaattaggatatgagaagtgtaggagtaaccctgtctcctaaagtaattaactcacacatgttctctgaaggagatgatcaatcagaataatcatgagaaagcagcttttggcaaaactgaaataaaaaaataaacaaattgatacgaccccccatactggtgactaaaaaaaaaataatccattaggacaataggctatcatataagaaataaataagaaccaagtccaaatacatctttggaatgaaagagagatctcaggaaattcactcatttatacacagaaaacagaactcacgttaactgaaaactttaacaaaattctcctgagtggaaaattttaaaatcacccaaacaggaagaaaaatgcaatttgataagcaaaaatttcatttgaaaaatgcctaatgttctaacaccaggtggtgctatactattaagatttttttttttaatctcaccttttcttctttactccccacacagtttatttgccaaacttaaatgatcttcactccaacttgcaactctttcttgcagtaaaaatgtttccacttatcagtgaaataaatatacaggctgcgtatcctctggcatctctgaaactacattctcctgatgctcacgaacctgctacctaaatatgggcatttcccaagcccagtctttcgctcttaaccctcctcatgcccattctcttggagagtctattttctctactttcctctaaccattgtcctatgcggatgaatcccatgttctcacctgcagccctatcttccttctgaatctcaaggctactcatgttttaaagtacttattgagtactctaggttttcatcttagaccgacatgctcctgtttatgctaattatagctccactgttttatttttttaaaaatcttgctttgttgcccaggctggtctcaaacttctggccttaagcagtcctcccgcctcagtctcccaaactgctggaattacaggtgtaaaccaccccacccagccatatagccctattttttatttttttccagcttcaaaccattggaatcatcttttcttccccagatccccatatattctagcactgtctcccaatgctaccagtaccacctaactgaagactacccagagttgaaaaagacctttgatgaaaatgacattgttgcgtatcactaaggatcccataagtgagtcaaataatgctgctggaaagtaatgcccattgctttgttctagcgattttgctcataaaaacctcatcctaatggagaaaaagatgctgaagctcctcaggcctggcatttgaaattaccacattaagctcccctccttcggctccagcctcactcttgtatggctctcctacatccatgtgtgctctgctccgattaacctcgctttctctctgacaccagggcacatcatgtgctattctattaatattccaacaggcacatcatttcttttcaaagagctcttcttccaccctttgaatccttatttaaccctttatatcattgtctaaactgtattggactcctaaaatcctgtccttccatcccttccaactccatcatgttaatctcctaaatgtgaaaattaaggtcatgacccaatctaaaatttgggattctccaccatctacagcatgcggcccagcacagctttgaacgctaacccaatacaaattcataaattttcttagaacattatgagatttttttgcaatttcttttattagctcatcagctatcatcagcatattttatgtgtggcccaagacaattcttcttcttccaatgtggcccagggaagccaaaagattgcacaccccaatctataggatggtgatcgtagtttcaatccttttatttaatatttaatttcacaggcttaaaaggcaatgtggggttgatccctacccacttcttccccctcaggccatgcctctaccccttcatacacacacaccccttcgtggtttctctccagtcatttcgctctattcttctgcttacgcccatccttccgactgaacggcctcctttctatcccctcccctatttctgtccagtgaatccaaagtcagctcaagcttctcttctgaacccttgctactcatttgcagctccaccctaggcctactgaatcaccacctgcagtttcacaagatccccaggtgattaaaatgcacctggagtttctgaagcactgttgagaatcaggacctctctgtgagcttatcctgccaggacacccttctctgaatgccgtggactaagccttgctttctcctcacaccatgtacttgtttctatcacagcatttgcctccacattcttcttggaccatctctaaggttcctgagatcaggaagagcacctgattcaattctggtcctcaggaactggcaaaggtctagcatggagtgagacttaataaatgtttcctcaacaaattcatttttttaaatgccaacagtaaatgatgtattttgataatgtgttctcccatcatctatactgaagcattcagtgcttaacccatttttacaagcttatttgaatcttcagtctattagagacttttttctttacatcctttacaataattagcaactgttagatagcaaatacacactttaaaaatttatggttagccaccagttttacttgctttaggaagaacaggaaaacagatttttagaatataaatttgccaaattgccgccccttcagcagaaacactgatgagtcatcatcaaaactaataagcaaggttgggcacgtaacagatcaaaatgactgggccacagccacagtgcagccaaggcttcctacattttggaaatcagcttattcttcagaaatgcatgcctcatagctttgtttctaaacacaacttaggtttgcagacatttctgagtgtgcctgggaattactacagaagacctgtaccttcacacagctgcactagaggaaagcttaccccggcaaccaaatatcatttccctgacctcccctatctcattgtcacccccatccaggcccatcccctacacctaatggcagccagtcctcaccaaagtcttcccaattccaccatggctcttgactaatgagcaatgaggataatgaatgccgatttcaccaaaagattagtttctttgatagaataatcctaacagtgtgtgactattactatcccagttaatagatgagaagactacttaggtggttaaatggcttacttgggtcacatacccggccagtgacagtaaggcctagaatccaagtgtctaaccacctgcccagtgttccctcggccatgccacagaatagaaacatctcagttaaagaaaagtatgaggcttggaggcagacagagttcagaatggagctcttactggacaggagctcctacagcggaatggtgaaaaccgtacggatgcaacaaagacatataactatttcaccaacagtcccgacgtttagcttaacggtaaagttggcaatactaaaacatagcaatattaggttaattgagagactgcaagtaacacaggcgctaaattcttaaacagtgaaatcaatacaggacttctctgagttacagttccgaaaaggtgacatttaccaggtcatatcgtattgtgtaacttatcccagatgagaaagataaagatttaagatctacttgcaggatattattgacctcagtggtttattttaagctcgtgcacttagcatagacttacgtatagacaacagattggtttttattctgtaattataaccatcttttatgtagggaaaatctggaaggaataacacctccactttgccttagatagtaacacagtctattggatttgaagcaaaccttcactaatcaaccaatttactaaaatactcacctcagaaaacctgagtaagtatactatatttaacaacaataaaaatcagtaaaagacgcctagcaaaactaaaatttcaatggaaagattaagtgaacaacaggatagtgttaatattaatattatcctattctgtaaaacaaaatggtagaatggcgcttgccaggggctggtggggaagggaaatggggagttgttcaatgggtagaaagttccagttatgcaagatgaatacgtcctacagatgtgctgcacaacttgtgttgtaggaagctgggattacacccacacaacaccacacccggctaatttttttgtatttttagtagagatggggtttcatcaggctggtctcaaactcctgaccttaagtgagccacttgccgtggcctcccaaagtgctgggattacaggtgtgagccaccgtgcctggccaaaacagatcatcttaataaaaatctggacaatagattcacatgaaggtgtgtcttacacaagtatttatgtgcttacctagtaaggcaagtgcaagtaatcacaaagttcaaacatatacagagccagaaccacctgacatcctgccacagaattagacgttctcagtaaaaactgtaaactaaagaaaacatcatgtctcaccataaggtatgttgttctgtagtttatacagcttagtaggaacacaggtgggaagaagaaaataaggctggagaggcaggtagtttacagttgggtgagacatggcattgaatgccagactcataattttagaccttaaatgttagggatggatatggtgggaagatgtgggttgggggggtcggggagggtgaggcttttttagcatttacatcagaacttgattgtgtggtagcagtgtgcagaactgactgaagactgaaatcagggaaaaagataggaagctagtgtaccagcacctgccagggttagagaagtgagaattttaactaaaaaatgaaaagattattgaggtccatttgaaatatatcagtatggcacacaagtggcaaggccactaactactaagtaagaaagagaaaatgccaaactaacagacacagttaaaatacgagacatgagaatatgtattttttttccagttaattcagagaatatgtctgtagctataattatataacttgggttccttaaatacaactcaactacttagagacagttacctttagagtaattacctacagtaactaggaattattataaaatcaggggaaacttaaaagtgacaaacaagttaacaagttataagagaaataaattatacatactcaaaaccgtggctgcaggtccacttccaattaagcttaagggaccaaattctctcaccaacactaaatatacatgtttaagaacttagcttcaatggtagagtatcactgtataaatattaaataaacctgatgggcttcttaccaaataagtattatacaaaatccatatatttcctatgtgccaggaaaaaacagaaaaagaaatcccttactttggtaacaaaaaggaattgcacacatagacacacacatatgcactgtttctgtgaataaatttatcaaaaaagtgctattctattgtgaaaattataaaaatgagaaaaataaaagttctgaacaagtgtacacatgtgaattcttccatgaattgatatcttattaaatgctattgcaatctgaacctacatgtgattgcttttaaacgcaggaattgaatttttaaaacatgttaaagtaatctagaataattaagaatagccaaaaaaaaatttagaacagaaaaacattaagactacaattcaacaacgaaaataccaaaaaacccaatttaaaaactggacaaaggactcgaatagacatttctcctaagaagacaacaaatagcccagaggcacatgcaaagatgctcaacatcactagtcactagggaaatgcaaatcacaatcgcgcgagataccactttgtacctaatgggatgctatcatcaaaaaaaaaaaaaaaaaaagcaaaaacaaaaaattaacaagtgttggcaaggacacggagaaactggaacccttgtgcaaggctagcgggaatgtaacatggtgtagccactgtggaaatggtatggtggttcctccaaaaattaaacctgaagttaccatataatccaacaactgcatgtctaggtacagatccaaaagatgtgaaagcaggccgggggtggtggctcgtgcctgtaatcccagcactttgggaggccaaggcaggggatcaccggaggccaggccaggagtttgagaccagtctggcgaatatggtgaaaccccatctctactaaaaatacaaaaaacattatctgggcatggtggcgggcacctgtaattccagctacttgggagggtgaggtaggagaatcacttgagcctggaaggtggaggttacagtgagctgagatcatgccactatactctggcctgggcaagagagcaagactctgtctttaaaaaaaaaaaaaaaaaaaaagtgaaagacttgagcaggtatctgtacaaccatcttcacagcagcattattcacaatagccaaaatgtggaagcaaccctactgttcacaggcagatgaacgaataaacaaaaggtggtacagatataccacggaatactattctgccttaaaaaggaagttgacacatgctacaacatggatgaaccttgaggacacggtgctaagtgaaataagccagttataaataatgtatgattctctttcatgattactagaatagtcaaatgcatatagacagaacatagagtggtgagtgccaggggctgaaagagacggagaactgggggttagtaaaatggatacaggatttcaggggggaaaacaaagttctggagatggatatggaggatggctgcaaaaaatgtgaatgtacttaatgccacagagctgtacatttaaaaaattgttaaaatggcacattctgtgcaatatatattttgccacaatttaagttaaaaacaaggaacttgtgcaactagttggagtaagatattataaaataataaaagtcctactggaataaaaccatactgacagattaatacggtggtatatacatctcagagatataaaaattcaggataggataggataagggaggtatcttaaatcagcaaaaacatacttatttgtggtattaagatatttgaattgccaaattaaaatttgagaagcagaacggtacagtagttaatagttgacaatctcgaggtagatcgtctaggttcaaacccggcgccacctcacactgcctagtgagcaggttcctcaccgttctgcacttctgttttctcatatgtgagaatgggggtgataggagtactccttacctcataggttcttgtgagaattaaatgaatttataattttaaaatgcttagaacagcatctggcacaaagtaccatacaaatattagctgtcagcgctcgccatccaccaaaataaattaaattggattacaacgcaaagggcttaagatgaaaccataaaaaaaataattaaacataggtcagtcttcttgagtagggaccgtcttattatgcataaaaacacaggaaaagttaaaggaaacaatgtatttgacaacataaaagtgaaaaaaaattaagaaatcaccatatgcaaaataaaaagacataaaaacaacaggcaaaggaaatgaacagcagcagatcaaaaaaaaatcctatgcccccaaatataagtgagcgaaagctcttgatgaaacaatgaatacaaagagttgataacttttattattattcttttatttaacctcactgtgtctaacacctttcctggtgagccaactgtcattcctaatccccatcaccattgcttaaccccatagaagagtttaaaaagtcaaatacttgcttccaacctttcatgccagtaggggcaagagccagatctggtctgtacccatcagacataaggacaagagggcgaagggggagctgctgcatgggtgtccccatgaaaaacaaagagaggaggaggtccctgccctgagatgccgtcctttgcttccagcctttgaatgcagtcacaggaagtggtgggatgcacacggaactcctagcagccatattttaactgaaaagccaatgacaaagccacatgctgatgtgagatgagtggagaggcagaaagaggacatttatgaatcgtcaaacctggaacagcctgcctctagccctcccgaggaataaacacacacagcctctggtttatgtccactggttgggttttctgtcgcctgctgtaaattgtgttcttaactgcgccattctcctgccaacagtattggatgcaattggttcctcctttcttcttgaaaggctttccttacttggcttcagggatgcccctacgttcctggctgttccttcttgactctggagagtccagggagcaccccagagctatccttgacctgtgctctctacacttactgccgtggggctctcatccagtctggtggctttaaatatcctctatatggtgctgaatcctaaatttatatctgtagaccagatttctcccacgcacttcaaacttgcatatccagttttctactccacatggcctcttatcaatcatttctatgtaactgagtttcagatctccccttcccaacatctgtgtttccaccatccattcccatctcaggtaaaggctgcaccattcttccattgctcacaccaacatggtcatgttcatccgtgactcctccctttgctctcacccccaatccaatctaagcaaacctcactggctttaccttcaagcacatacctagaatctgagcgggcctcactgccacaacctggtccgagaaaacataacctcctgctgccatcacagcgacccccgcaagctgatctccctgttcctacttcacccatatccaatctactcccaacacaactctcagagtgatcccattaacatttaagtcactccagttcaaactccaagtcctaactatgattttcaagactatacatgatccacgctgggcacggtgcctcacgcccgtaatcccagcactttggaaggccgaggtgggtggatcacctgaggtcaggagcacaagaccagcctgaacaacatggtgaaaccctgtctctactaagaatacaaaaactagctgggcgtggtggcaggcacctacaatctcagctactcggtaggctgaggcaggagaatcgcttaaaccagggaggtggaggttgcagtgagccaagatcatgccattgcactccagcctgggcgacacagcaagactgtgcctcaaaaaaattaaaaaaaaaaaaacagcagacactgtctccattatatacataaacatatgtgcatgagaatatgcaaaaagaaaaggtaccaaatagtcataaatttttaagttaaaagctatttggtggtggtaagatgacaggtgtttattttctcacttttaatttaaaatgctatacctttaaaatagcctactgggaagagagtagtgtaaacttgataaactatccaatttgcctggttaaattcaagacacaagaggtaaagaataaaacagggccccgcatccctttcttgacattgacaagaggctctaggtcagcctcttctttgttgactgccagaaagccaatctgttgtgtcctaatcacctgttggccctcctctgtattttcacaccatcattactgactttgacctcaatctctacattctatattctgagccataactcctcttctcattctaccttctagtatctcagtcaagtcctgaaaaatagctcaatacatgtgcatcctccttacttctcagatctcagggggcaaaagttaaacagcacaaagcatcaacattaaaccaagcctggcccctacctatttaagagtgtaactctattacattatataatctcctatattacagaaagaaaaccattaagcgaactttggtatttgtaattacaccctcttccaaaatcctacagttctttttattaaattttagtattataagaacaaatgtgatgaaacaagaacttgtcacctcttctatttggcagttaataccaagaaggcaaaaactacatcttactcatcccacaatccctcagtgtctggtacatgacttacctagcatacacgctctatctgttaagtaaatacgttgcagaacacagaatatttcagtaacactctagatttatatgttgcaaatagtgattttactattccaccttcttgagttcatcaaggcaataggactctgtataactatcctcatttgcttaaattcaagggtaagctccccagacaaaggcagagcaacacaggtgagtcataacaaaaacacggcaagtcttaagactgcagtaatttgacaaaggagcaaaaagtcccacaaagggaagttctcacgatgactcgaactccacagaagcgcagcattctcggtgatgctgtcagtacctgcctctgcaagtatgttcacaagatgtctgtggcttcaggtggggattaaacaaaaataactgccttagtcacaggcctggaacatgtgtcccacaactacaggaacatttaaattcagaggggaataaaccaaagacttaaaggtgttgcttcattttcccagctaccatacaaaggagataaacaagggtcttcacatgttcaccagcaaatttatttaccatctgacacctatgctaataatgcctgataagaacaaaagaaggtgcacagtgagcctcctggctcattaggagtcaaggtttatgagcagagctccactgagcaatgaggtggtgagatcattgagacctcaaaacttcacaccaacttttttttttttcttttcttttcagagggtctcgctctgtcaccctggcaggagcacagtggtgcaatcatagctcactgtagactcaaatttgggctcaagagatcctcctgtctcaggctcccgagtagctagtagctgagaccacaggcgggagccactgggcctgtctcttatatctttatgtcagctcttttctgatggtttccttagtctctacatatttttactcttaaacctcaggcatgcacatacccctctgaggtgcttcccagtctgtagcctcctccaatttcacatgccccgaattaaactcactattctcctccggaaaacttcttgctactctattccacatttcacttcatggcccaccacctatccagcctctgaaggcggcggttggggagacacttaggactgttcacaccaacagaagtggccagacactctgtctcctaattattttaaacatgcattctactatccgttcccaaaaaatatgtagcactcgtgcaagtttgtgtctacattattagaactaatcagcctctacctccctcgaggcagaggctcatctgtcattgaccccgggacacgtctgctccaggcatgctgactctggccttgacgttccccaagcacatggtatcctttgacaaggccacatctgcaccctcagcaaccccagcagcctcctctgctggcaagctcctgcaggcgcattccaaacagttcaaatgtcaccgcctctcctccagttctccctcacaacaagttagtgttgctcctttactgtggatacacagtgcttcgcacaggtctccattcaaatcaagccaaggaatgtttttaaacacctgttgtgcaaccagtacactgtgctgggcactggaaaatatgaaaataactaagagctgaactctatccttatggatttcaccgtctagaaggagacagacatgtaaggaaataatgagcatacagcactataaatgcaaagcagcagagaggccaggacagctgaggtggaatctgaagagccaagagttttcattggaacgatttgcttagacacccccttatcccctcaccctccaaccagtaagctccttaagagggcatatttgcttaatcctgtttgtagtctcagaatctagtacactgcccaacacagagcagcgactctaagcacttcttgaatgaatgggcaagcctgcactgtgacatattaagcctactcatgagtcattccacaaagcaatcttctccataattactgccaagtaagaattgtgtgaaacgcctggaaaagatcaagcatttacaagtgatgatgtccgtgaggatgaaaagaggacatgtgcctcgcaggcacctgcatggccctgcttggttggtcctgacctcctccgcccatccatgtcctccagcccccaccacacacagtgcgtggttcactgttcctcacgcaccctacaccctgcctcacctcggggtctctgcacggctggtccctgtgcctggaaagtcctcccgcctgacacccaaatgcctccctcctcccttcctttcaggtgtttgcccaaatgtcgccctctcagtgaggcctttcttgaccaaccgtttaaaaatctaatctccttcactgctttatttttattttattttattttttgcttgttttttttgagatggggtcttgctctctcacccaggctggagtgcagtggtgcgacctcagctagctgcaacctccacctcccaggttcaagagattctcctgcctcagcctcccaagtagctgagaccacaggcaccggccaccaaacccagctaatttttgtatgtttagtagagatggggtttcaccatcttggccaggctggtctcgaacttctgacctcaagtgatccatctgccttggccacccaaagtgctgggattataggcgtgagccaccatgtttggctctttctcttttatttttggattcatcatcatgaatccaaaaatgtatttattttcttaatccccttattagaatttaagctccctaatggaaggaacgggtctcttctgtgcacttcattccagcacttagaagagttcttagcacaaaccagccttccccacattctccttcacacatatgtggtttaatgaagaattcacatatgtccatgaaagaagacaggagtgtgtcaagacttctgcatgcacgtaaaggaccagggttaagagcacagactgtggggccagaacacccggcccatttcccgtctccaccaattaccccactgtgtaactttggacacgttactgaagctttcagaccctcaaattcctcatctgtagaatggcgattatcacagtatccctactaggagttgtgggaattaaatgagattatgcatttaaaagagggcttagcactgtgcttggcgcacacaggcactcaaaacatgttagtgactaatactatttttatgaaaagagatcctgatacacactttaaggaaactaatttaattacataaaaatatagaaacatctattagcgacacattaaaattaaattttattcacatttcagagacagggtcttgccctgtcacctagcctgaagtgcagtggtacaattatagctcactgaaccctcaaccacttgggttcagtgatcctcccacctcagcctcctgagtagcaaggaccacaagtgtgtgccacttgcccagctaattttttaatgttttgtaaagacagggtctcactctgttgcccaggtgggtctcaatctcttgggctcaagtaatcctcccacttcatcctccctaattcctgggatcacagatgtgagccaccatgtccggcctcaacttggcttttagaataacttattgggtaataacctctgatttttagtaattactttattcaagtatgtgaaaaatctctcataattttgcttactgtctccctcaaattctcacctagaaaagtttaaaaggatataaaagtaatttgaagaagatttgaaattaccttaacacgaaatgaatgaaaaaataatcagtttacataaaccacgaaggaaataacttagcaagaaagaagagaaacctgcgatgacaggcaagtcactgcaagtttcggacggactactgtcttgaaaggaatttactttattaacccacaataaactcaactgaaataaagagttgcccttttgaaatgtggtttctctttctctagaagaaaaccaaaaaccatctctttcaggaggcctttcttcaccgacccacccctggacattcttctcatggggccttttccccacccatcaccattctttgtgccgctttgtgtttgctgcataaacacgcactctccctcctcagctcacaggagtcacggggcagggagagcattctgcgctacttctgtaatcctacctggctcaggctggcctctgaaatggcaactcatgtgtgtagagaagaacacagatatttatcatctaaaacctgggaaaagctggtattgcctccaaaagagagtgaaggcgggtctctctaaagatgtctgaattgatcatgaaggatttactcagcagttatttattcagcagcattaattttattattactgtattttttattgttttaagttccggggtacatgtgcaggctgtgcaggtttgttacataggtaaacatgggccatggtggttgacttcacctaccaaaccatcacctaggtattaagcccggcatgcattagctatttttcctgaagcagcattaattttcaatagccacataaaatcattcacatcagagttaacatcaagctttaaaccaaggcctgaaaagaaaagtgccacagtttctaaaccattcagctgggcaacaagaattttaatttttaaaaaaattaaacgttagcctggtgtggtggttcatgcctgtcatctcggtactgtgggaggcctaggtgggaggatcacttaagcccaggagttcaagaccagcctgggcaacaaagtgagacccccccatctctacaaaaatatataaaaatcagctgggcatgctgacacacatctgtgataccaggtacatgggacgctgagacaggaggatttcttgagtccaggaattcaaggctgcagtgatctatggtggagtcagtgcactccggcctggacgacagagtgaaaatgtctcaaaaaaacaaacaaacagaaaacaaacaaacaaaaaaacaaattagactttattattaaaaataaaactcaggccaggcgcggtggctcactcctgtaatcccagcactttgggaggccgaggcgggtggatcacctgaggtcgggagttggagaccagcctgaccaacatggagaaaccctatctctattaaaaatgcaaaattagccaggtgtggtggttcatgcctgtaatcccagctactcgggaggctgaggcaggagaattgcttgaaccagggaaggggaggttgtggtgagccacgattgcgtcaattgcactccagcctgggcaacaagagtgaaactccatctcataaataaataaataaataaattaataaatcaaacaaacaaaactcatggccatactaatagtattgagattaataatgtgttggttaacagcatcactggctggtctgaatcccacctctgccactttccagctgtttaacattggacaaattatttaacttttctgtggaagattccttgtctataaaatagggataagcctcaaagttactgtgaggattaaatgaatttatagatgaaattactaaaactgagcctggaacccgacatatacttaacagtgtgagctgctatcattgacattataataattactactacaaataattttcatcactatctcatcttatttcagtatatttccaaagaagcaaaggtagtttagatttggtttgttataatctcttataatctggtctcatataatatatttccacattttgacaagtaaaatggaacagctctttgggaggccaaggtgggtggatcacctgaggtcagaagttcgagaccggcctggccaacatggtgaaaccctgtctctactaaaaatacaaaaaattagttgggcgtggtggtgggtgcctgtaaatcccagctactcaggaggctgaggcagcagaatcgcttgaacccaggaggcggaggttgcagtgatccgagattgcaccattgcactccagcctgatcaacagagcgagactccgtctcaaaaaaaaaaaaggaaaagaaaaaggaaaaagaacagctgtgttgggtttaattacaattccttctcacattcattttaaagcttcaagaaaatggctgtttcaatactgggtctggttttctacttaagtgttctgaaaggatttattgaaaacgccaaattggctggaacatttctgccgcttacctttcagcagagtaactgtgagtcagtatggtggatatccatttggtttcaatttgctaatacacacagacacttcattgtacaatcaatggcaacaggatcacggggatctaaaagcacattgtttctgctccttgatttttctgttctacttttaactctgtggcgattaagaaacacctctcaatttactgagagcatccaaaaaaattagttgctattaatttttctgtaaaacataatacagtagaatcaaattagtcttcttagtcggctcaggctgccataatagtaataataccagatggggtggcttaaacaacagaaatttgttttctcacagttctgaaggctggaatgtccaagatagaggtgccagctgatctgcttcccagcaagggccctcttcctggcatccagatggccacattctcattctacctcacatactgaggacagttccagtgtctcttcctcttttcttttttgaaagagagtttcgctcttgctacccaggctggggtgcaatggtgctatctcggctcactgcaacctccgcctcctgggatcaaggaattctcctgcctcaccctccccaatagctgggattacagtcacctgccaccacccttggctaattttttttttgtatttttagtagagaaggggtttccccacattcccacattggccaggctggtctcaaactcctgacctcaggtgatccacctgcctcagcctcccaaagtgctgggattacaagcgtgagccaccatgccaagcccatctcttcatctttttctaagggcaccacccctactggattaggatcccactcttatgaccccgtttaaccttcatcacctcctcaccagccctgtctccaaacacaatcacattgcaggttggggcttcaacatattaatgtagagggacccaagtattcagaccataaaagtcttctaaccagtcaaatacaaaactcaaattcaaatccagaatgtttccagttacattaactttgtttccattcagatacagaaaaccacccagtaaaacgtaattagtttttaactcagactgaaaaatctggatgcataactcagttatcaagctcatcgacacaggatgataaaagctcaaaagcatgccctgtcttttcactaagactaaacagatccacttttctctaagacacattatgcaacacagagtaaaaggacttaacaactacttccccgctgggtgggactgatcgcctacataaaaggattctatctttttcaatgtatcctgggtactggcctcatttcttaaaagtatgtgcgcttagattttctgggattcaagccccacgaaattcagagaatcataccagtaacagcagttactcagaaaattaggtgagctccaaattgtccctagaaaggtaagggctgtaaaagctgacagggtcttagattctcagacacttacactttcaagatgtgaagatgaagcccagggagagtaaaagacttgctcaggcagcgtattggggccagagtggaactaaaacacagggctcctaactgcaggccaggggccacactccagtgccaccaagctacaggtgttcctcacagaggaggaagggagcttcccattctctgcaagcaccatgagccttattggacaactacagtaaggaccagagctttttcttcaccaccaagggacagggttttgctctgctgcccaggttggagtacagtggcatgatcatagctcactgcagctttgaacttctgggctcaagtgatcttcctgcctcagcctcctgaatagctgaggagcccctacaagggcacaccatcatgctctcatgcccagctgttttttttttttgttgttgttgttttttttttttttttttttagagatagtgtcttgctatgttgcccaggctggtcctgaactcctggcccactttggcttcctaaagcactgggatttcaggcataaaccaccacacccagccaggactagagctttcatctcactcatgccttgactccccaggtgtggcaatatcccaaataagaatcactctttctcccaatggcttttggcctctgtttttctcccagatgatgaacactccaagctaatgaattcctgtttccacccagatcctctggggatggagccatgtgctgcaaacccctcttcctccactcacgcctctgtggtcatgtctccttgaccttgacactaggcctgaatctaaataaacagcccgtaaaacatttctaagcattacaggctttcacacttgaggcttcatggtagggttgaaaaatgaaacctacaaatactaaattgtagagaggtacagagatcttctgggatttgctcgctttcattagtttccataaaacattctcacgtgtgtggacacataactatttgtataagggaacttactactaaattgatttgacatgactttaatttgcccaaggctgtaccggcagaagtaaggtgggttctttgcaagatgttctcagtcaattggaatggctagcaggcttttcatccccgtgacacagggatgacttttccatttctttgtaacacagatctgtacgtccgccaaatttagtatgatacttaatagctattcttgaggcgctcacatttcattggcctaacatgactttaaaattacaaattgtaagatacaagccaacataaataaaagttcacattagaaaaatttaactttttagtcaccctcatatccctcctaaatctatcatacatctttcagtaaaattaaaaaaaaaattaatctcttcacatgtattgagggcacactagggacctaccgtacaacacttcagcattgttaagcacttaaccatttgaaaaaacttaatgaaatgattcaaatttacatcagccacccaattgtatatttatgtacacatccttctgaatagcttataagatggtttatacacctatacctctctcctcaactagcctttgccttgctcaaagataagggatatatgttgtcatcttctttttctacctcctgtgctcaggatgctgatccacaaaaggctaactgctttagtgacagaaggcattagacctataatcatgactgtccaattttacattcaattaactcataaactattgaactattttattcttaccagaactggacacacgcctgatcctctgaggagatacggctcgatcagcactgggatttctattgtcactgttccgcctcaaacaggaaacagggggccccactttggcttttggagcagctatttgcctcaaaccgcaggagtcaggcttggatatattcctacctgaggtggtcgttgtttttgaagcagagccctgtgaaaataacagttaagactgtaaaccaaaactaaaattctaagccccccaactgactgaatgggcccctcctctaggccaaggcaattccaaagaaacctaaaaaacaagttcaggccatgatggcaaagaggtcagacatgcctcattatactctcctccctttagaattcaggcacaactgaccagaattaacattaaaacagaaaccttaagtcagacaaaacagactctttatagcaaaaagacactaaattccaacctgactctagtttagcatcacatgacagacagcaagccctgaaggaaattgaagtattttaccccaaaatatttttctttaacacattttgaaatggccctgcaaagctgtctcttgtaggggcaaatttacattctgtagagaatcttcttcccttcccagatctttggtcccaaagaaattagctgagagtctagcaccttttaaaagtctaaataggtaatatttgccatctattacctctaaaggcggccacgtatgagatttcatctacataataagaaccttggtctccacagccccttatcttatcttaaccgagacactcctttctattgatttcaggtctttagataataacttctttagttttttgacacggagtctcctctatcgcccaggctggagtgtagtggcatgatcccagctcagtgcaacctctgcctcccgggttcaagtgattctcctgcctcagcctcctgagtagctgggattacgggtgcacaccaccatcaatctttttacttttagtagagatggctaatttttatatttttgtagctaagttttgtattttttttttggcattttatttttagtggagatggggtttcaccatgttttcttttttttttttttttttttgattttttgtatttttagtagagatgaggtttcgccatgttggtcaggctggtctcaaactccacacttcgtgatctgccgcctcggcctcccaaagggctgggattacaggcgtgagccaataacttaattctttcaacgaactgccaagcagtaaatctttgaatccacctatgatctgtaagtccctacttcaagatgtctcatcttcccagaccaaactaacgtgtatctcaaatgtattgactgatgtcctctgtctccctaaaatggatgaaatcaagctgtaacccaaacacctaggcacatgttctgaggacctcttgaggatgtgtcatcagccatggtcctcatatttgggtcagaataagtctcttcaaatgatttagagtttggcttttttcattaacaaaattttaatccagatcataccttccccataccacttccttgtggtattagctacgtgaaaggaacaatttctaagtgaacgtgtacagttgtccctcggtatcaaaaatgattagttccaggaccctggcagatatcaaaatccatggacactcaaatctcttatatgaaatggtgtagggtttgcatataacctatgtacatcctcccatatactgtaaatcatctccacgatcattacttacaacatctacctattacttgtttcaggtggattcaacatagtattcagcatgtagtaagttcaagttttgctttttgaaacactgcagattttttttctgaatattttcagtccaagtttggctcaatccacagatgtggagcccatagatacagagggctgactgtattcaattttcatttttactatgaaacaattaaaactcttcacagcttactctttaattcaccatattctgcctttgtacccattagtgagagtgtactcaagatcaccagtgtcacaagttaaattcaagctagttttcaatccttcccctgggggctctctctacacatcgaacgttaataactccattctctggtttcctgacaaagctctttcctggttttccttctacctgtccggttattccttttctgggtcctattcttctgtacctttggaagctagtgatataatttggatctgtgtccccacccaaatctcacatcgaattgtaatccccagtgctggaggagggacctggtgggaggtaactggatcatagaagcagacttcccccttgctgttcttatgacagtgagttcttacaagatctggttgtttaaaagggtgtgtcacctgccccctcactctcttcctcctcctccagtcatacaagacattgcagccttgcttcctgtacagcctgtggaactgtgagtcaattaaacctcttttctttataaattacccagtctcaggtagttctttatatagcaatgtgagaacagactgatacagctagtcttcatgaagacctagccttggccctgttctctttcctcaccatgtactcttcctacatgatcttggctgctgtttcaattgccacgtgtacactggtacatccaaatccacatgttcaaccagtactctctcctgagtttcccatatacctaacttctttctatacatcccaactcagcatccttcaagcacctctacgtattagtccattttcacaacgctgataaagtcacacctgagactgggtaatttataaagaaaaagcagtttaatgggctcagagttccacgtggctagggaggcttcacaatcatggcagaaggtgaaaggttcatcttacaaggcagcagacaagagagaataaaagccaagggaaagcagtttccccttataaaaccatcagatctcatgagacttactcactaccacaagaacagtatgggggaaaccacccccatgatgcaattatctcccaccaggtccctcccacaatatgtgggaattacaggagctacaattcaagatgagatttgggtggggacacagccaaaccatatgactctacttaacttactaacatatagcccgtatagaatactattctaaattctaagtatatgtatcaattcacttaaccctcataataatcctgtgaagttggtaggtttattgtaccccattttaaagaacaagaacatgaagcattttctaaaattaatcttactttcctatctatctcaaaacttatctcttcctgtattcaccacaacatacccaggcacccaacttcaacaatgaaagctgtttctcttttccatctgctgtcatttctcagcaagattactgaaacgatgtccacaggatctttctggtctctccagctttcaattcatcttttatctgcctgctagggcaatctctctcaaactcgaatagggttagacaccttctgtctgtcttccagataacatcttcttcacaaggcccagcaatccttttgcatatggaagcccctgccatcctcttcaccttattccctactgctcagggttccattctcccagctcccaccacacctacctagagtcccctaaattagaaaatcttctcatatttcttcagctttgtactctacccagaatacctgcccttcaaattccagctagtgacaacatgtgatgtcccctataagccttccttgacaactctgcccaccaccacatcttgttccccctcctgcagcacagcagtctactcacactcccaacttagcaatcaacatacccttgcctgtttactgtattgatagaggcaggaggcagagaaattctaggcagacgggggcaggtccccagcaaaaccccaccttcaaggcaaaaaccctgaaacccacagcctaaagtgagaacttctaaacctgtttgcccactctctcctaattagttctttctgaataatgtctttttaccaattgaaagttgccttttccaaaactacctatggcctgccttgccccccacatcccattcatgtaaagaccccagactcacttggtaggggagacaagcggcttgactgatgtattagtccatttttacgctgcttataaagacgtacatgagactgggcaacttacaaaagaaagaggtttaattggacttaagagttccacgtggctggggaagcctcacaatcatggcagagggcaaggaggagcaagacatgtcttacatggatggcagcaggcaaagagagctcatgcaagaaaactctcccttataataaccatcagatcttgtgagacttaatcactattatgagaacagcatggcaaagacctgcccccccattattcaattccctcccactgggtccttcccacaacatgtgggaactcaatacaagatttgggtggggacacagccaaatcatatcaactggagacttcagaggacagctgagtctactgtcatatcaccctgaacacacccaatctcgcctgatctttgaagctaagcagggtcaggcctggttagtacttggatggcagacagacagctggactttggaggagagatggcttagctttggagaagagccaagtgtagatggccagactttagggaagattatctgcccgtcctgtcccgtcttcagctaccctctctgctgagagccactttcattgctaaataaaattatctgcctccaccatccttcaggtgtccatgtgacccaattcttcttggacagtggacaagagcttgggacccaccaactttgggtacccaaaaaaggttatcacactgaccctttgccctcgctactggagggcagctgccccacacagtgaggcaaagggcccactgagctgatgacacaccggtgtccatggatggtggagccaagagagcactgtagcatgccctctggggctttagggtcacagacaccaccacctgggcaccactgtggggcctgcacacagcatgctcctgccggtgctcaaagtggctggctggatcctgtactcacttgcccacacactcctgcccgcaagaggttgagcatggcgggctgaatggggcacccccatcgcaagttttacaaatgggttgagaaaaactcctgcaacagtattacccactgcactaggcactcagacagggtctcttttttccctacatcctaacaatcatcaccatatgtataatacatagtatgcacccaataaatgtttctattctacatagaggaaatgggagtctgagccttactcacagtgtgaattccaacaccaaactacaatttgcaattctccctttacattaatgtaaagcaaaaataaaattctaagccccccaaccatctgaagggaccacttctctcggccaagggcattccaaggttaacctgaaaaactagttcaggatatgaaaggaagggggagtcagacataattatactctccgaagggttggaattcaggcacagctgaccagcattaacatcaacaaagaccttaagactgatagaacagactcttttaagtctgataagcaacatttacaatcaactccccctgaagccggctacctgaaggtttcatctgtatgataaaaccttggtttccacagctccttatcttaacccagacattcctttttgttgattccaggtctttaactctttgaaccaactgccaattagaaaatctttaggctgggggtggtggctcaaacctgtaatcccagcactttgagaagccgaggtgggcagatcacatgaggccaggagttcgagaccggcctggccaacatgaggaaagccagtctctactaaaaatacaaaaaaattagctgggtgtggtggtcctcacctgtaatcccagctactcaaaaggctgaggcaagagaatcacttgaacccgggaggcagaggctgcagtgagccgagagatcacaccactgcacccccagcctgggcaacagagaatctgtctcaaaaaaaaaaaaaaaaaaagaaagaaaaagaaagaaaatctttaaatctgcctgtgacctggaagctgcctccacttccagttgtctctcctttctagacagaaccactgtataccttacatgtactgattgacgtcttatgtctccctaaaatgtgtaaaagcaagctgtacctcgatcaccttaggcccatcttctcaggatctcctaagggctgtgtcatgggccactggtcactcatgtttggctcagaataaatctcttcaaatatattacagagtttgaccctttttttgacacaaagaacaactgagctcaatagagacttagtaacctgccagaggtcactttgcccagtaaatggtggagctacaatttgaaactactctaaaatccgtgcttgtaaagcagcatgttccctgtcatcactcttctttctttaataaatctcaagtgttaatttccgatagatacacataaagcccaatgccgatggcagtcgaattcatacattaggtgaattcaacaataacttagcaggccaatcacccatgagaacagctggaggtcatgttttggcactggagaacaatacagaattggccaagaaaagcaagtgactgtacacaaactaacaaagatcttctgtctctggctaggttaaattaaagctggctaaattcatctcccagagaaaaatcttcttttaaaaagcaacccaaaagttaacctcccagagaaaaccttcttttaaaaagtaaggcaaactgctcatcaatttacaaaagtgaatcttcagcaaatcacttgttttgcctttcagagccaacattccaaaaattttgaaaccgtatggtgtatggagcagaaaaggccaggattcaagtgagggctctgagtgtgaatcccaattttactatttaccagctgtgtgagttttaagtgacctcgctgaagtattaaaatgtcgacaacaattgccctgttgttattgggaagagtaaataacaatgtatggaaagcacctgagcgttacagggcccattaaatggcataatataactaaggcacctgagcaaagtgcctgacccagagcaagcactgaataaatatcaattcctttccttttaggttaagtctccactccctttatctcacacactatcatgaacacataacctctgttgtgaggagctacatctagccccgtttcaaataaaaatcaagttccttcttccaaataagaacttttctaaagattcagatacaccctgaccaccaatgagctgtgaggttgcaggcagtctagggattcagtaaactcaaggcctaaggcaggccaaggccaacaaagcaacagtaaaaattaacatccgaccgggcgcgatggctcacgcctgtaatcccagcactttgggaggccaatgtgggcggatcacttgaggtcaggagttcgagaccagcctggccaacgtggtgaaaccccatctctaataaaaatacaaaaaattagccaggcatgtgcacctgtagtcccagctacttgggagaaatgcgtgaacctgggaggcagaggttgcagtgagccgagatcgcgccactgcactccatcctgggtgagagaggagactccatctcaaagaaaaagaaaattaacatccctccagcatggtctcttcgtcaatccagggcagtaagagcctttgagtgctgctgaagtgaccaaccgacattcatgtttcaggaaaacacgcagcaaattcattcagctctctacagtaagtgcaaagccagtggcctatgagggtctgcccagacactttccagtcctccttcccagagacatggaaatgtgcaagaggtaaactagcaaaattagagagcactgtgcttcagacatgatcgtgaaaaaagagtaggccgggggcagtggctcacgcctgtattcccagcactttgggaggccgaggcaggtggatcatgaggtcaagagatcaagaccatcctggacaatatggtgaaacctcgtctctactaaaaatacaaaaattagctggatgtggtggtgcacgcctgtagtcccagctacctgggaggctgaggcaggagaattgcttgaacctgggaggcggaggttgcagtgagccgagatcttgccactgcactccagcctggcgaaagagcaagaacaagactctgccttaaaaaaaaaaaaaaaaaaaaaaaagaaagcaaaaaagaaaaaagagtcccttatgccagttgataagcatatgcgaatatgggacaatctttcaagacttacaaagtatttcatatctaattatgaatcctaacagccagattcctgaggcgaaaagtgctgtttctccaagacatactaggatccatttcaacctgatgattctatccttacctcagtaccacatcgggagcctgaaaaacaggttttcaagctgcacaggggcaacataaccctaagactcaatgcacaaatcaggaaaacttttagtttcaaaattacacaaccaatttaaattcaagacaaatgtcattaaagaaaaagaaactttatgatagagtttttggtagctggggactgacacaccaaaaaaagtctcccataaatcaagagaataaacatcgtgtttctatgtatatctgtaaatgccaaactaagaatgttgattagaattaagagtatgttgtaatttaattttgcaaaaaaattaaaattataaatgatatcggttttctaagtttgacttcaagataacttaaaaactaaatctgagttttgaaacaacggatgaactcattagtttagaaatcactgtggtgtacccttcttccaaatagagaagactggttgttaaagcccaaacatgtctaaactgatgttttagagaatctagaatatcttcggtctttcctaaccttgtcttctaaacggacctgacaattccctcccttgtggtccccatgcaccctgaagacacacctaagtcagcccttctgcacttgctattctatgtgcttcattcctcttgccacgagccctccaagggacaggctgtctgtgtcacacctgcctttctccgctggcacttagctcccttcctggcccagaggacaggcacccaaggacagcctgtctggggctgaaaatacacctaagtccccactgccaaaaatagggctgaggacacatgcccaacgaccaacagtggcctgtcaaatgtttttaaaacccagaaaaccaatttctacacactattctcaaaaacacatgcatgtttaaaggaaaatcacctttacactgcatgtgaattctttattctttaaacagcactctctaggtcccccccaaatattttagacaggcgctatggaaaacatactggtttttcactatacataagtaaaagattttattttatataccaggaattaatatattaaggctgcaagaggcttcacacatccactaggtccaatcctttcatctttgggtctcgaaaaattacttgccaaaaatcattattggccggtcagaggaaaaatcaagaacactcttgctcatacaagagggctctacttcccagagctgcctcctccgcaagagtccaggagttatttttatgttgacatgtttaccagcactcccaagccctttcttaaatgctgtccaatacattttaaagttgacaacccaactttttcagaaaaataaaatataacctgattgtatcaggcacttaaactactaattatactaaaatattaaagtaacttcatttttcagcacactattaaaaggaacggtgatacttgatacaaaatactgaaattgaggatttttttttccatatgcagttttgttgtattgaaacctattaacaccccagtactgacaagacaatgaattaacaactaaatgtaaatctgcccacctggttctgcaatattattgactaatagataactaaatgctaacacatctcagttttctccacagttctctgaagcatgcaaaaaatatatatatattacttaccaaaaacagagaaccatattcaaaagtctcattcataatctcttgtttcagctcttgtttttccatagatgtcccattttctttttcacccttcttttcagggctaatcctatcaatgttgggaacataggtcatttccaaacattctgcactttccattttaacagggagtatgcctttgatcttctgaaacaacgcagaaacggacccggtctcgcatgctgagttagaagaactggctttgtcaacatcttcctgattcgatttcacggcagatgttgttcttggaaccctgtgtgaagcatttttagaatgagttgtaacatgcacagcctggctagtaatgagtttattaaactgctgcttatgtgtcttgttaattagaatttctgcttttttgtctgcattcaagtcagatctcggtgttctgctcaagactgtttgttgtcttgaattcactgatgagggtgatgaggcactggtctgctgaggtctgggcgtgacctttgataaagcagcatctttgggctgcaacactgctctagacataacttttgctttgacattcttgaagtttggtcttgggtaacttataatttcagtttttctaactttgcagcctattggggtattcgttttgattgttgattttcctaaactgggtttacacaggttcacaggtgcctccttcgagtctggtatgtttttaagccctcgattacccttctccactttcttacatttctccgtcgcttcaatcggtgaaacagaaaaggttacttttgtgggttctaggactggtgttgacatgcacatcgttttgtctgtgctaatgaccatatcatttgcatcccaagtcagtccaaatgacgagcccaccttttgtcctggcgggctacttagaatcaattctgaggtatgattttgggttcccaaatcctttcctttggagaccatttgtgtgtcttcagtctcagtgactttatgctctgggttcagcacttgagcttcgctcttatcaaaagctggcaccattaaagggcattcatcatcaataagacaataggacactgtctctctcagattttggcccatttccttgtgcctgtatgagctctgtgaatgtggttcgctattggattcatcatgggataaacaaaagaactcttgtaatgcagaatcattggggacttccatgccatcagaaactggtgttagtgcttgtgtctccttttctccaactagtctttgttgtgatccatctgtgtactcactggtgacctttcctgaagaacatgcacactgatttccaatatctgaaacaaaaacctcactttgcatcaccacatcagaaaatgctgtgtaagtcatgtcttgggcttctgatggtgtgacttgagggttttcaaagctttctctatcataagtagtttctcttgcatgcgtcttatcagaatgggaagatgtccaagtggaataggataaagaagatgtacttccacttctcctaccagttggtggcaggcttccagcagtatggaaggactgactctttccgatggcatgatgtgatataaaggtgcagttaactttatccactgtcatgtcaaatgtttggtttagctccaaggcatcacagtagcctgcacagttcaaattgtcattaggcttccacacaaaaggcaaagatggctcaacactctggccctcaactgcttctagggaatgacaactgtgttgcagatatttgggcttctcagtacctacaagtgcaggacactgacaaatagaatctttatgcatatctaacacctgcttactaatgaaatcactagaagacttttcatgaccaaatacttcaacaccctgaaggcttaaagaaatattttcaccagtaactacagcagggtcagtttcataatcaaccaccatgtcatctgggttggcagaattccagttcacactgctggctgaagagttttgtgtaggtggtgatttcgggttgtatgcatgtgtatttccatctttatcactggtaaagaaggtttgcaattcatcttctattttatcatctgaattatcatcagtcatcctgaatagtaaccttaaacctctgccattttatttcttcttcaattccttttaaatgagagggtgggcaaaatggtctgtcttctaggtttttcagcacagttgaaaggttttcagtctaagatgctctgaagattaaatgatttgttgttccctggaagaaataaaatgtttaactcaagtaactataagaaaaattaacaggccaccccttggtttcaatcactaagtgattagtttcaatcactttatgttcacatttagaccccacaactactgatgtgggtaactgagatataatcaggcaatctatcaccgcttttcaagatacttttttaatttgagggaatagcaaatggggcaaaatggaagatggggtcattgctcgttaaccctgtccctgactttataactgatatgcctctcccccactcccagggacttgtcaaagagaggaggaggtaaatctggcaatagtattttcttcttgttggctgacagagtgacaattcacccaaatttgcttatgacagtcccaaagtatgtctgttgtcccaggatgattagtaaacatgtccctttcattctcagaagggcccccctattatttccatgcagagtgattattagacaggccatgaaagcccagcaaatcagctgaagatcaatcaagaactcacgtttctcctttgtttttattcctatcttaaacatatgctatttccaaattgaaggggaaaaaaaaattgtcgattcttaaaggctccagtggtaccctgttggaagtcccttgaaatgtgagttaccttatgttatacactaaactgttccccacccctctccaattcatatgtcaagcccaaacccccaccccttatgtaactatgttggagacagagcctttaaggaggtgattaaggttaaaagcagtcataagcgtggagtgctgatccaacagagctggtgcccttagaagaagggaaagtgacaccagaatgctctcccactcttggttcatcccctctctctaccaaattagggtacactgagaagagtaggagagctctcaccaaaaaccaaaccctgaaaagaaccttaatcttcaactttccagcctccaaaactgtgagaaagtaagtttttgttgtttaagccatccagtgtatgataatttgttatggtggccgaagaagacttaagtaccacatgccccagcaattctactcctaagaatctactgaagaaaatgaaaacatatgtcaacatgggaacttgcacacaaatgtacatgattctaaatagaagcactattcataatagtcataaagtagaaacccacatgcccatcaactgaagagcagaaagcaaaatgtactcttatgcatttgacaaaatattcctcagcaatagaaaggaatgcaatattgacacatggtacaacacggatataatattacacttgaaatattatatcaaatgaaagaagccagtcatgaaagtctacatactatatgacactatttacatgaaatgtccagaataagaaaacctaaagtggctgctaattgggatgacgtttcttttgcgagtatgttctaaaactatgtactgatgatggctgcacaatgttatatactgaaaactactgaattgtacacttaaaaatgaaaccattaaaacacccacgaaagcatttaaatctaaaactttttgcaaataaattattattgcttttttgagatggagtcttgctctgccacccaggctggagtgcagtgatgcaatctcggctcactgcaacctccacctcccggtttcaggcaatcttcctgcctcagcctcctgagtagcagggactacaggtgtacaccttcatgcgtggctgatttttgtatttttagtagagacagggtttcaccacactggccaggctggtctcgaactcctgacctcaggtaatctgcccacctcggcctcccaaagcactgggattacaggcatgagccaccacgcccggccacttttgggaaataacttaaattttattatgcttttggtcaaactgcagtgccaaagaaaggtccaaatgttcaagctaggactgcaaacaggtcattgtgaatcctaaaatgagggctgtgtgatttatattctgatggaaagtgtaaatttgttaactctttttactactgcaaacagatacgcacacacttgaactaattttctaatcctagtattcaatgtcaatccgatgtcacagtactgttgtaaagaaaaaaaaatatccatgagggagggaaaaaatgccatttcgtgtgttaattcaacttgccgaatgaagagtaggtctcatttttctatcttgcagcgttttctctgcattcaaacttcagtggcctgaataaaaccagaataggaactatgttaaaactgaaacgatcagttttcttcgctaacagtgctctgtgtctttctggccaagcatcctgataccagcctttaatggaataaagaaaggctgcaatgttgatttcaacagcatgtgcacacatacacatccaaaaagcgattttgaatccaaaaatgaaggctgcgtgatttatatactgatggaaagtgtaaatttgtgaaccctttttaccatataactccttagtgaaatcactgaatagtttattggcaagagccttaataaaagcttttatgaaacataaattaacatttttaatcctccagtataaaatacatccaagctaaatgtttaaatcaagaaatatatttattcatttttaggcttacatgcaggggatataatttccaaaagcactaaatatgctacagctttctgcttccctaacagctaatactcagttaacagactgtggcataagcaaatatatgcaaagtgcactgcaaacacgcacttagcatagatcgtgggaactgtctttgtaaataattgttagcttcaattaatggcatttttattactcaagtttcctcttctgaagtgcataaaagatgatttttaaacctcatataaattgaattaagggctcatatgtcaaagttattttttatttatttattttgagacggagtctggcactgtcgcccgggctggagtgcagtggcgcgatctcggctcactgcaacgtccgcctcccgggttcaagcgattaccctgcctcagcctcccgagtagctgggattacaggcgcccgccaccatgcccggctcattttctgtatttttagtagagatggtgttccactgtgttagccagcatggtcttgatctcctgacctcgtgatccgcccgcctcggcctcccaaagtgctgggattacaggcatgagccaccatgcccggccccaaggttattttttaaataagtatgtaagaggataaataattttatcactagtcctatgtttgtttttaccagttgtctttttttatttttcttttttttgagacaaggtctcactttgtcacccaagctgcagtgcagtgatgtgattacagcttactgcagcctcaacctcctaggctcaagcgatcttcccacctcagcctcccgagtagctgtgactacaggtatgtgccagcatgcccagctaatttttttaaaaaactttttgtagaaaaggggtccagcttttctcatttataaataatactaaactgaaatcttcacaatctttgacatctgatcatttgccaaattgctatatttaaaaagggggcaggattctttataatgtgcatgttactatatatgtatattttatatatatatataaaagttctctttctttttatatatttatatataaaaatacgtaatataaaatatatatattatatactgagttttgcttttaagactcatatactgtggtcagcattgtctctgaagcattttcccatgtcattatactataaaaacatttttaacggttgtgaaacgccactaaagttaaggttaaatgttttagatttacaagctagtggtttacaagagtaacagaaaaataaagaagccatcaaccatttaactttcacttaacattttagtacacttgggtttatgatttttttttaattcacaaaaagagattgggtgtggtcgctcatgcctgtaatctcagcactttgggaggctgaggcaggagcatcatttgagcccaggagttcaagactagcctgggcaacatagcaggaccctacctctacgatttcttttctttttttttttttttttagcacggtggtgcatgcctgtagtcccagctgctcagaaggctagggagaaaggatcacctgggcccagtagttcacagctgcagtaagctatgatcatgccaccacacttcagcctgggtgacagggaccctatcactattaaaagaaaacaaaacaaaataaaacaaatttcaaattggtgagcaaagagactaaaaaacccacaaacatgtgttcataaatacttaaggattgtttttatataaaataaatttactgacatctcttctactttgtagacaagagtaaaaaaatagtggtacagggatttggatatcaaaaaggttctgcagttaagctgatcagttccagcaagatggaagatcaacctcaccattcatgaaaagaaaacaatggctttaagtcaccaccaccaccaccatgaagacaaagccaaggacagaaaaggggtgaccggccttcgctcaggagtttgtcaaaagagttaaaagttggccattttgttttactgcctattttatttctccccgactttaagaatgggtcctaagcttgcaccacttgctcgacatatatattctttgccttcatctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaaaaaaaaaaacttgaaacaaaccatcctcacccaaagggataatttctcaagttctcttttggtagtactacctaccagaacaaaggtataacaccagaacaaggtataacaccagaacaaaggtataacacttgtgtaacactccagaacaaagcagaatgatcaagtttcctttctaagagaatcatttgggaaaacaaggagatctttttcagagaacattttggaccagagagaacaaattccccacttattaaagagctgggaatgtaacagagcagctcctcttaaacggttaccaaaatatatatttccctaaggatttataaggattaaaaattagtaaatatgtgctgaaagaaatggtcaaagaactactagtacaagctttgaggtataattccaatgcctttggaaaaaaaactttctaaatcttagcttaagaaaagtgattgtttattccccaaagataaaaaattccattatttcttcatgtgaagagacacacctaaagaactgaatcattatattaattacaattattatcatataatagaattcatcatcattaccatattaatgctagaagaaattttaaagatccaattcaaacttcattttacaaatgagaaacctctgagaaatcaactgcatgacgtgaccaaatcagttgtcaatagcagattatacaatagctgtgtgccttatttcaccaactgaactagaaactcaatagaggcttatataagagtagatgtcttctatatctccctattacccacagtgtctagcttaataatttggacctaatatagttaaccttgtaacaccatattataactataaaatcaagaatgtttccaaaagtaaaacataagaactggcttcattactttataaccacacagaatgtaattttactacttatttatgttaatatatggcacgccagtcctttaagatgtgaatacaaatacagttataatttatagcttccaaatcataaagccattatcagtcttcttaaaagtttttaagaactcacaaatcacaatagtagtttagctctgtaagctttaaaacccaaaatattacctgatcttcaacctcccttgaatcaaaaaagatgacattggcacaacatctaagctatcattttatcttactaaaaacgaagcagttgaggcctggtgcagtggctcaggcctataataccaagactttgggaagccgaggtgggcggatcacttgaggccaggagtttgagaccagcctagccaacatggtgaaaccccgtctctactaaaaatacaaaaattgccaggtatggtggcaggtgcctgtaatcccacctactcaggaggctgaggcaggagaatcactggaactcaggaggcggaggtcgcagtgagccgagatcacaccaccacactccagcccaggtgacagagcaagactttgtctcaaaaacaaaacaaaacaaaaacaaaaattaagcagctgaacaaaatgtcatcagcagcatgtattataaaaaatatattcataagactccacctcctgttaaaaccattcaaggtagctaacagttctactctaagcctcaacttcctactatttttcataatgcaagcttacattcttaaatttgctcttgcagcctacctttcatcaaacttaatagccacctcaagcactacgtttaacggagcatgtctaccacctaggaaccgagtagaggagtacttggtggtcaatttcctaaaagcataacgatttcctatgaagttgcttaaatcaacagcaggaaactagagttgatttaatgcatttcaaaatggtggacggctatgaagtaatacaagttataccttaaataatttagaaaacaagtataaatttgaaattacatccttttattctgaaacagtatttctctgactttaatgtgcccacaaatcaactgggcctttggttggtcaactgactgattcagaaggcaaggatggggcctgagattctgcatttctatccttctccctggtgataccaatccttttggtccatgggccaccttggattagcaaagatgcggcaaagagctttgagaaacacctgtccagttgaccagatcaaaaacaacagtggctgtcagggctgactgctttcacatccaatggtaccttttttttttttgagacgaagtcttgctctatcccccaggctggagtgtaatggcgcaatcttggctcactgcaacctccccctcccgtgttcaaacaattctctgcctcagcctcctgagtagctgggattacaggtgcccaccaccacgcccagctaattttttgtgtttttagtagaggcaaggtttcaccatcttggccaggctggtcttgaactcctgtccttgtgatctacacacctcggccttccaaagtgctgggattacaggcgtgagccaccacgcctggccggtaccatttcttaaagtagatacagactttctctacatttggactcttaatttatgcttttgaatgctgctctcaagacagctcatattttgcatctagaaaataactggaaatgcagagaatgttgtttccataccacttcggcttattccttccacgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaattatacctgaatgttttaaagggttttttggtggggaaagaacagtgatgatagatattcttaaatactgtaactactttgaaagaagagaacaacagttaagaactatgtcattttagtcatcttttgttttgtcaaaacaaagatgttacaggcctgtgcttgtttaatatgaaaaaactctatgatctacaaatccttggggatacagagaatcagggtagctggtgacatctgacctatcctcttactcactgatattgttcagaaatccaagctaagaggttctaaaatagcagggaaaaatggtaatttctatgcacttgcatttttatgaaagaaaactgcaaaaaaaaaaaaaaggtaatttctatgtacctgcaattttatgaaagaaaacccattaaacaatagtttataataatgcatcccctacacactgaacaatttccctgttcctgtttcatctttatatcttccccaggtctgcttcttttaagacgtcttcacacgttaatctagtccaagggctggcaagccatttctgaaaaaggccaatataaaatatcttaggctttacaggatgtgcggtctgtgctgcatttattcaagtctgctgttgtagaatcaaagacgccacagacgatatggaaatgaacaagcgcaactgcatcccagtaaaatgatttacaaaaaagaggcagtgggccagacttggccgtggactgtagcttgctgacccctgaactagtctatgccctaatcccgtggtccccaacctttttggcaccagggactggtttcatgggagacaacttttctgcggaccaggaggagggggaggattcaagcatattatgattactgtacactttatttctattagtattacattgtaatacataatcaaataattatataactcatcataacgtagaatcagtgggagccctcagtttgttttcctgtaagtagacagtcccatctggaagtgatgggagacagtgacagatcattaggcattagattctcataagtagctcgcaacctagatacctcgcatgcacagttcacaatagggttcacactcccaggagaatctgatgctgtcgctaacatgacaggaggtggagctcaggcactaatgcaagcgatggggagtggctgtgaacacagacgaagctttgccccctcgcctgaagcctacctcctgctgtgcagccctgttcctaacaggccacagcccaggaattggggaaccttgccgtgatgaatcaaaactagctgtcattggctgggcatggtggctcatgcctgtaatcccagcactttgggaggccgaggcaggcagataacctgaggtcaggagttcaagaccagccttgcaaaactctttctctacaaaatatacaaaaattagccaggcgtggtggtgtgcacctgtaatctcagctactagggaggctgaggcagaagaatcacttgaacccagaggcacaagttgcagtgagctgagattatgccactgcactccagcctaggaaacagagcaagactctgtctcaaaaaaaaaaaaaaaagactagctgtcatctatacttcaccatcattaaaatacagacaccacacacacacacacacacacacacacacacacacacacaaatgcacacacaatttttttggttttatttttatttcttggctctttcagagacaggtcaactcaattcaaggacagtatactctcaattttctcgtaaagtccattactacatctcttcataaaaataaccactcacaaaatcaggtaccatagggcttctaaattacctaacaacaaacagaaatagcaccaaaaattggttcttacttttcacaaatcctctccactaattatcatttaagatatcatttactatatgaaattatatactttacatactataaattatacactacaaattaagagacctttatgctagcattagtttacctttgtttaaataaaaaagcttaattgtcactttagaggcattttaagactggttgacactgggtgccgatttagtgaatttttgtcaccaagttcaagtttgctacagctgtcaaagatcataaaactgaaagcatacggtattagcaaaaacaagtcttatcagtatccatgcaattttaaaaagaacagaaacttggcaactaatgggtaattaaatgtctgcagaccatcacatgtgagtacacccagtacacaagtaatcatcatccttaatgagaatgagaaaatgtttaattcccactcatgccaaaggccacatacaagtctccttcctccatgagatctcctcctactactcaacatggctatcttttttcaagtttaataggcaaacctctctcagcacttgactggaataactgttgcaccatttgggagttatttttcttttagacatttgcagatcttatctgaaggtgactaagagcccagagttaagtatttgtgaggcaatctatgcgaactctgaacttacctagttggcttatatgaaatttgtagaacgcatggcaggagcctgtgtaagaaagtattgtcctggttttctggtggtttgttgttgttgtggggtctgagaatgtacagccaacccctcttttataacagagaattgattttgatacatattttaaaatatgatagtgcagagttaatggatgttaaaattttattttcttgttttggtaggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatgaccagtatataataagactggcacaaccatttgccatcttttcctgttatcatcacatagtgtgggtggggagaatgaatggaaatcactccagaataatgacaaatggtttttaaaactctatgctgaatacattccagctgataatgaccgacttttcttttttcactttggtgatatcatcctcagggtaaaaaaaaaaaaaaaaaaaaaaaaggcatttataaaaaacagtttcataaatcttttagttataaacaggaaagttttatattatgtgtcatttcatttctagactgttgatgatgatgataaggaatttggggccaattttgatatatgaatgtattgtttttccatgtggtgattaaagcttccattagcagtttaaaaaaaaagagtgagaggaggtaaaaggggctgggtacagtggctcatagctgtaatcccaaaacattaggagtccaaggcaggaggattgcttgaggcctggagtttgagactagcctgggcaacacagcaaaaccccatctctttaaaaaaaaaaaaaaatcaaccaggcatgggggtgcacacctatggtcccagctactctgaaggctgagggcaggaggactgcctgagcccaggatttcgaggttacagtgagccatgatcacgctactgcactccagcctgggtgatagagcaagaccctgtctcttaaaaaaaaaaaaaaaaaacggtgtgaaagagactgaagtgcagcaagatgctccaagtttgggggttggggaacatgaagataaagagccaacggtttggtcagctcaagagtttggcttctactctgagagcaatgggagtctgccaaaggagttatgatggagactgatgcttcgaattggctaaaggtggaagatgtcctagtgaggagagactagacgcacgaaactgctagggcagatgggaactcctggcagtggcagcacgaggcaaaggagaggacaagccagacacgcttaaaaggccactgctgtgtcctctgccctgagcagcagagaggctggcacacaatatgtgcccaatacaggtctgttgaattaaacattattttaaaagactacttcacttacattaatatttaaagaaggaagccacagcagatagtatcagagagctgtataaataatgtatcacattctagagagatacacgaaggatttacgctttgagtataaactaggagagttttataatgttctctcttctctttcttcaaataaactaatatgtgagctcaggatattaattcaggattttccagggtcttgaaggtcttttactcaatccaaaataaataaaagagaggttcaaaacatgaataagagatctgggttaaaatgaataatttattaagcatagagacagatactagtttaattatccaaggaaaactaatttgcttctttctaaaacacacacatttaagactttttaaaagaaaatcatatacaacaaagaaagctatgagagaaactctgtttatgccatggtaaaaaaaaaaaattaaaatgacctcaacaaaaatatatcaccccctttccctacccaccctcaaagccacatgaggtttgtatttaaaatatctttaagagcctttttgcagcaattagaacatttttatacaaacagtcaaaaattatcaagtgacttataagaagatagaagtctcctacctccaaaacaaaaaacaaaaacaaaaaaccattacaagaccaccagcagagaagagagagtcctggtgggcagacagcattccaaagtcctctaaaactgatatcaacacaccagaaaagtcaaagaatctcccaaaaaatcatgtttacaccaataaagattaaacaattaatggtattttgtttacacttctggagttttcgggggatttttgtttttgtttttttaatatggttacaatttaaatgggcattggagtggaaaactgacttactcagtcaatagcacagtatagtcagtttgtcttagataactcacactatgcaattaaaaagcctctgcttgggggtggaggagcaagcccctagctggtgatagcaaagacagcaccccgaaggagaagctcccagcaaagcctgcgggaagtataaagattccagacaaaatcaattcactgacctgctaaggttcaagaattctgattcctcaagttcattccaaaaaatgcttttattccttttttttttttttttttggctcaacaacttcctaaaacctccaaaccagcatgtggaagaccttacacattcacaaactcttaaaactgcatttctgaaggcttagtcagtaatttttttttttttttttttgagacagagtctcgctctgtcgcccaggctggagtgcagtggcgcgatctcggctcactgcaagctccgcctcccgggttcacgccattctcctgcctcagcctccccagtagctgggactacaggcgcccgccaccacgcccagataattttttgtatttttagtagagacgggatttcaccgcgttagccaggatggtctcgatctcctgacctcgtgatccacccgcctcggcctcccaaagtgctgggattacaggcgtgagccacccgcgcccggcccttagtcagtaatcttaataaggaaaatggtttaacattttcagggcatcctatattctttaaacatatcataaaagcagcagaaataacaaagttgtgtttccctcaatcctcatctcttgctgtgaagacgacatgaaagccaaattaaaatgctcagatcattttaaatcataagcactcaagcagtttcagttttcttctctctctgacccactgccacactctttgcttacacacacacacacacacacacacacacacacacacacacacacacggggggggttgggggggaagcactacagtcagaatcacaatgcaaaagtgagaaataagcaaggttctagacacttcagatgacatataaagtatataatacataataatttcctgccgcactccatacaattgttggtgtaaccataaaataaccacagtcatttgtaataatatacaacatttttacatgttgcttaatgagagtttttgtacttgatattttaacccaaagcagagccctgcatttgattattatcctttacaaaaagtacataaggggatactcacttttctgcataatcatcttagcattttcaaacgttctagaatttagcctgaagtaggggtaatctaataaagtatgataaataccacaaacaaaatataagcaggtggaaagcatctaagatttaaagagcagcttcaaaaaaaaatcccttttgaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgcctttggttgcacctcagagactgtctttttcatggagcaatgcagaaactgcaaccagactacaggaaatacaaacaccagaccgtacaatgaagcctctctggggactatgattattcaaagacagttcagccttgcagcagtaatagggctgagtgtaacgacttttttattcttccaaactaaagaattttccttggactctctgccaatgaaacatcacagacttttctgaggctttacaggcagaaaacttgtacgcagatgtttcttggttatactgtacacatcacttgcaataaaactgtaaacaaacaaaaacatgacaagttctttaagcaattttcagatcatctctgaaaacagaaggcacttttgcctgtcagattaaatcagcattcactgtggctgggtgactgcttctggattaaagaaactggaatattccagtgatttggataatgaaaaagaaaaaaagttttaaaggtaagatgttaagtatgcatctataatataattggaatttagatgtaaggaataacctacattaatctggctacaattgtacttctcactcccttgactaattacctataccaataagttcttaggagtgttatatcctttaaacttaggaacttcagactgctcaaaaattatcaagttaataataaataaaataatctgtgtaaggaaaagttcctgaaagatacataccttctcattagcagtggttcaccatctcaggtcaatgatgaggaaggggaggcagggggctgcactgtaagtttactttatacatttatataattatttaaatatttgtaattacttttggaattttgaatatcaaaacaaaataaatttatgctccaatggaatcaaatacatgcttcatgcaatgaagttttcaaatcaacgtttctttcacagacattgcaattaaaagatctgcaaatcttttattcagaatcttgggccagcgtatctgctctcagcaatgtgaataactagtgtcatcaaagctgttactttacaaaatagtcagtgtagtccctaaataaatgtctttcaaattccaacaacagattgtctgaatcagacacctgaaatgcatgccaagaagtcttgcaagcaggcagtctacgcatgaaaacaaaccctatgatagattctcttgaaattaaatacaactcttacaacaaagacaattttactattttccgataaacagggtccactcatggaaaagagatcgactaacatggataattcatcgtccagtgtttacagtggctgagttcatttaacccaatctactagttctgtatgtgagaaaactgagatctagagaaaagaagttacgatttctactagtgtctactgcataactctatgagtcaccattcacaccacattctatggacagaaacttcactggtccatttacattaaagatgatggccatggtggcccagaattgtgcagggtagtggcctggatgacttttaagatgacacaatgatttagaagcagaatcaggatcagaattatctccttcctctcctttagtttaccatcatcttgcctcataaatgtatgaaagaaagcaaaatacaagtgcatttaggataaaactctaatttttatccttgaaatggcatgaatactgcagactaatcctaccttcagaacatcgtatgtattaaaaggaatgcctatagaaactagacacacatgtacaaaacaaaataactgaaacatttaaagatgtcctacaccattatactatattaaatactttgtgtcccaaagctacaggtgaaaacaagaataaatatttcactcgcattatccaaacttgaatccctattgttttcaatatccctactgactgtaccacagaggatttaaagagattcataattatgactgtcatattatatctgctaaaacataattatctggtcctgcttcccagtagaagaggccagtgtactctctactgatgtcataccaaggaagcacttatggctacaatcactgatgtcaattaacataagaaaccagtacattcagtactctagtaggttgttgcaaagcagattaagttttcctacaaagagaaactaggcccaaaaccagacaaagtatgttcaacttcttcttataacccactatcattcaatgttagagaaaatctaggcactaagtaaaagcatttcagatcatcactttgtaaacagccagagtagttcttctaatttctgaaacaatcacctgtaattcagcaccaaaaaaacacacaaaggaataaaaggtaaggaaaaaccatatgaacataaggtgcccttgaaaagtactggcatggaaaagacttgaagattatataacaagactaatccatattagagaatcaaaaggagattaaactcccaaagatacgttcagaagaaaaactactatgaactaaattatccttcctttccatattgttcatgcaatatacacacatgcacaactttcccccactttcacctagttgggatgagatgttaatttaggctgaaggactattatttctctttactcctgttatgccagagaggatccaagaggaaaaaagatatacagtaaaataaaaagattaggaatcagagccccaaggaaaataaaagactgtattaaacatcactgcaaatcaatgtctctgaaccgaattttttaaatattttgcaacgtctcagatcaccatacgtagtgcaggagcaggggaagagtcttcaagagtcatgctagccacactgtcattagaggtggcctagagatgctctggggttacctgaaacaagccaaaaagcccagtgtctatatcaatggctttcctacataaaggcaaatctagggtaagatacctcactttgatgtatatgttactatgttttctgttgctacaccatagactgggtaacttataagccatcaaagttcatttagctcagggttctgcaggcttagagtccaagaacacaaaactggtgtctggtaaggaccatcttgctgtgtcataacatggagaagggcatcacatagtgagacagtaagagcctgccagctcaggtctctcttcttaggaagccaccagtcccatcatggggtccacacctgatgaaattatctaaatctaattacctcccaaagactccacctccaaacatataaaatttgggagtcacattcaaatcatagcaatggagcaccaaaatcccacagggtctttccaggaagaactcttgacatgtccctcatcactcctgtctatgtcaaccagcttggacacagatctacacatgcatggatcaatgactagcatttctgaggtggaagccagggcccacagcacactatataaaaataagactaggaggcacacctaaccattccaacgtccatgttcttccccactgtgcagccctcacatctacattctctcctttagctccctcacctcattatatgaccttaacaatcctgctggtaaaggcagtccccaacccacaagcatataatcttccaaagtttgcctggagatttatttaacttaaagctcgttttcctagataaacgctactaacagcatttctctcttaatagcattctgttaagaagctcccaggctggcctccaatctgaaacccatttaaaccacaatgcagctactactagtttgggaaaacactagcccttcacatctgcataaacgccaaacagctgaacaccagttaggactttgtttccatgtgtctaaaagaaacaaaggtgttgcttttcctacttgattctggctagtaccacctcagtctcaaatcagaagaggataaggactggggaagaaaatgaaagtaagtttacccctttctaaaatgtgaagaaaaggaagcggaggtgatgccaccaggcattggggtgaatctcatgagaagatgctcaacatcattagtctttagcgagatgcaaatcaaaaccacaatcagataccacttcatactcgttaggacacctatgatcaaaatgctggtgaggatatggagaaattggaacccccttgcgttgctggtggaaatgtcaagtggtgcagcagctatggaaaacaattctgtggttcctccaagagataaacatagaattgccatatgatcaagcattccactcttatacccccaaaagcagaaaatagagactccaagaaatctgtacatccatgttcacagcagcagtatttacaataaccaaaaagtggacaccatcaaaggtgtcagtggccaccactgacagatgagtggataaacaaaatgtgatctatacatacagtggaatattattcagccataaaaaagaatgaaattctgttacatgctgcaacatggctgaaccctgaaaatattataagtaaaaaaaaaaaaaaaaaaaaaaccagaaaaggacaaatattggatgattccacttacataaagcacctggagtagtcaaatgaatagagacagaaagtcaattcgaggttaccaggggctggggcaggggaacatggggagctattgttaaatgggtacagtttctgtgtgggatgatgaacaagttctgaaaatactggtgatagttacacaactttgtgaatgtactttatgccactgaaccgtacactcaaaaatggttgaaaacgtaaatttcatgttatatatattttaccataattttttttttaaagcaacaccacaaattagaagagtcagagctaatggcttcacctttggatacctcaaccttcccaatctacagaataggagaaaaataccgtaccacctccgggatcctgaaacttcaggctgcatcatgagtatctgagacctcaaatgctaaatcctcaaatgtaaagggtctacacgacagcatgcatcacgccctacacacctgccaggtggaagcttttctaagctagatggtcgcacagaaagcagccatgtgtacatatgaacaagtttcctaagtttgcaagttctttgttaaaatcttcaatgaaattctcactctattaacttaactatcataaaagagacattatatcatagaagagtaaaattatcatagtaaccacagcaagtatgctgacaaagatgttttcgatgtagctgtttagaataaattactaggacaaacatctggacccatggccaccaggcactgggcaaacagagctcaggtacagtctcctggtgaggcagcctggccaacctgggttaccccagtgggggcctaaaaataaaagtgacaagacacacagcccgatactgagtcgcatgactacgcaggcatttcagagtgaagtcaaggtgcttaggttcctactgggccgccaagccattcagcatcagcgccggtcccatctgcaggcaaagaatgacacaactacctcttcatggaatattcccagtcaaagcccacttaataacgaggtccttctgcagggttaaacaaacctcagttagaatgcagcatggtgctgagtggtctttcaaacttgcttgtatttacagtcagccaactgcagattgaacatagtcgggagaaaaaaaaacaacaatacaaaatacactataacataactagtataaatgtatttacatagcacttacattaggtattaaaagtaacctagagatggtttacagtctatggaaggatgtgtttttatatgcaaagactacaatattttatataacgaacttaggcattctcagattttggtattgacggtgggggcgggggtgatcctggtaacaatccctgcagagacctacagacaatacacagaagtctcacatacgaggcccagtgcagtcaggcctgtaatcccagcattttgggatgccaaggtgggcggatcacctgagctcaggagttcaccagcctggccaacgtggtgaaaccccgtctctaccaaaaatacaaaaatgagctgggcattgtggcacatgtctgtagtcccagctacttgggaggctgaggcagcagaatcacttgaactcgggaggtggaggttgtagtgaggtgagactgcaccacggcactccagcctgggtgactgagtgagactctgtctcaaaaaaaaaaaaaaaaaaaaaaaaaaaaatctcagatacaaggcttacataaagaaagcattcaataaatgttgactgtaaattagattttccttgctattaaacattactcataggtgacgatgagtgatatttaatcactattaacaactgttttcctatctaaatacaaatttaaggaaatatatgcgtaatactccctgggctctctcctcttttaagacctaattgtaattgcgctttcggagagcaatttcaacagctgtaagacttgatttcatgatatcttacttaaaatggaaaacctgggtgtgggcttagtccacaacaaccccctttctctgaacacagcccctcctactcactgaggtgggttccactaaatgaactagtgaattagccctcgtgcagacacttaagtctaacagtatgcaattttcccacccccagcatttggatttgaaacaggtggctatggccgggcactgtggctcatgcttgtaaccccagcactttgggaggtcaaggtggttggatcacctgaggtcatgagttcgagaccagcctggccaacgtggcaaaactccatctctactaaaagtacaaaaaaaattagccagacatggtggcgcacaccggtaatcccagctacttggaggctgaggcaagagaatcgcttgaacccaggaggcagaggctgcagtgagttgagatcacaccactgtactccagcttgggtgacagagggagacactgtctcaaaaaaagaaaaagaaaaaaaaaaaaaaagatgtcaggcacagtgtgtccctggaactaaataacataaatccaggcgctgtgcatcagccaccttctccacacacccaaaagcagagaaagcaaatctctacagagacgtggatgggaccaacataccaaggggagcagaaatgaaaaacagtgaaggttagattgcctcactgacttggttcctgagaacctgccagacactaagttcttagaaggactccatatccttatcacacccatccagtttttgtccctatttgcttgaatttttatgactttccattaagagtctcaagaaaactatcgtcagaaatttattataggaaatatttcagcagattttcagtatattttccacatctgtgaagacttagaaatgatgaaaatgttgacaagaaggaattagaaaaccacagtacagtgattcaataaaatgcaactatttataaattatgcagtttacaaaactaggaaaaatatttttgtgttttatgattcctgctatgtaaaatatgtagaaaaagcaacacaggaaaacaaaaacagatgtgggtgggggtatggagctgtgggtcactgatgccattttattatcttgcctgtgttattaaactaggaagaaaaatctaattgccaaaaacttgaaataacccaaatgtccatcacgggtagattatttttttttaattgtggtacattcatctgatgaaataccactccacaacagaaaggtaaaccattgatacacaaaccacacagatgtatctcaaacacatacgctaagcaaaagacgtcacacacaaaagtctccatactctataactccatttatataatattctggaaaggcaaatctaagggaacaggattggtgtttgtctaagaatgggcaaagactgaaaggggcacaaggaaactttgaaataatgaaaatctattttgctgagtgtggttggtggttgcacagctacaggtgtttgtcaaaattcattgtactatacacccgaaaagtgcaaattctgctatatgtaaattatacctcaataaaccagacttaaagaggagggcaggtgtggtggctcacgcctgtaatcccagcactttggagggaggaggcaggcggatcccttgagcccaggagttctagagctgcacggtgaaaccctgtctctaccaaaaaatccaaaaattagccaggtgtggtggtgggtgcctgtagtcccagctacttgggaggctgaagtgggaggatcgtttgggccctggagggggaggttgcagtgagctgagatagcaccactgcattccagcctgggtggccgagtaagactctatctccaaaaatatataaaaataaaaataaagaagacactgagctcagacaccaaaccaaagctactgaggcacctgtaaggtgtctgttttataatattggatgacattcatcattcatcaaatgtactgagtgcccatctaatgccaaatgctctgctatgagctagtacagagtgaacaaaatagacaaaaaaatagacacaactatacaaacaaactacaggtcacataggaaagcatggatgctctgattgctattacgggattaggggtcaaggaaggcctctctgaacaagtcacacaagcttagaccccaggaataagtagtaggtaaggaggcagagactggaaaggtttctaaatgtgtcattacagcagtagttaacagcaactcaactgtttcaacatgtgacgggtggttacagtttactattttgctgtgataaggattatggcctcctacataagaagccctagtaaatgaaggttttaaaacagcctaaagacagtgaccaggagacgtaatgatgtgttttggatttcagggaccatcaaggagtacgttcctccaatccttgtcaatatttcaaaaatgatcaacacatgtatgtatttccctgaaatgaggttgcctatgggtaaactaaaacccatgttctggtgtttaaaagatttgttgtatttgttcttacttctggctgaatttgccattatttatttaacaaggtttcctgaagcttatcaacgtttctaaatgataatgacactcactcactctctctctcaccaaaaattggaaaaaatggtcccagtttgacaaatcgaaacctcttcacaatacgggaatcaaccttaaagaaggcccccttcacttggcttcagaggccctactctatcttggttttcctcctaaactcacagacttctctttggcaaatgcctctaagagattcttctttgatcaacatccaagtgttggagggggggcgggggcagccccttattccttctcttccttcactcactcttgtttcaaatacactccgataacaattcccacatactcatctctagcactgatctttccccaaagctccaggtttgaattctcaactgtcaatgtgacatctccacttacatgtttaacaggaatctctgacatgggttggatgtgtgtcccctccaaatctcatgttgaaatgtgatccccagtggttgaggtggggcctggtgggagatgactgggttatgggggtggatccctcatgaatggcttggggctgtccacaagagggagtcagttcttgcaacatctggttgttgaaactgtgtggcagcggactctgggcacacttcctatggctttgccctgctccacaagggacagccaaaaaaaaaagtgtggtacctcccccgtccccttgctcttgctctcaccatgtgacatgacagattcctgctgccttctgccatgattggaagctgcctgcggcctcatcagaagcacatgccagcaacatgcttcctgcacaaccatgagccaattaaacctcttttctttatacattacccagcctcgggtatttcaatctagcaatgcaagaacagtctgatacaatctcaagcttcaagtctaaaagggaactctgggcttccagacccctgcccatttccttcttgtcctagtgttcctggttttcaacaaaagacaccatgaatatacctcaagccaaaaacctaggagtcagcaataatctgcctctttccctctctccccagtagcaactccgacaggcactgccttcaaaatacatttcaaaagcaagcattcctcaccttcactattatcccaggtccaagccaccactgtctctctctgggactactaactggtcaaatcatgagcctctgcctccttacaatatattctcaaaacagcaaccagagtcatccttctgaattgtactcagttcctgccattcctcagtccaagccttctaatggcctcctatcacatctaatacaaaaaagggacccagtgacctaagacaataattagcaacagactaacctttatgcaaaaggtgacgtgaggcatcatcgaaggtaagggagtgctcactgccatgacaaatcagatgacacagcttacacttcatagtcaatcctgaggggctgtggaagaatctaggaaactcaatgacatttcacccctaaatcaacaggtgtgcaaacagaattatcctcttatctaatcagatctccataagtaccctgaaggcttcaaggaataagagtgtgcctgtttttgaccacggattatttacttgcacaacttctcaagtgatctgtttccacctaaaatggaacaaaggagtctctaaaagaaatactacgtttcaaatatctcatagccaatcagcaaacaactaccattctgaaaagattttgtctgaatttccaatcaaagtttcttccagcccatatgacttcaacatacaatttgtaccacattgtaaccaaagagttattagtaagaatgttaaataatcctcccctaaatttcaacttaaaatgtgtagtctttgtttaaatggcctgttgtctgcaagttttgaaacaaggcttcactttgtgttcaaaggcagtataaggaaacaagacatgttactgtttcgattcctctgaatgacagtgattaatattaaacacaagagtttcttacaaattagaattatccagaaacatatcccagtaagcctagcctcataaaatgactaacttcaatatttactttcatttctaaaattttttaaatcaaccactaagactttaacctccccctacacacgccaagaagaaatgctggctctcccctgcactggccacacctgtctttagacagcacccctttcctgctcgacggcctcctgcccccatcatgtgatcaacctctggcatcaggaaggcagtggtggctctgtgccatgaggtccctctttgtaggctgtggctatttttgggctggcagcccctctgattcctgacttggccctagataatcatgaggccgcctttagagagaaacccttcagaagccaggcaggtccctgtgggattagcaacactccactgctaacacagcaagtctcaggtcctaagtgctataaaggccctccaaggacagcgccctctaacctgatggccctcggttggccagacccaaggctgggctcccatttcaaatgggcaagtccgtggttttatggggctaacaaatcaaagctgacacagatatactactcatacatggattttagccaggaaatttcaaacaactcaatgatgggatttttttccccccttaaatgtcatgtccattcataacagtgagatttcagatgtgtgtaacagctttgggaaaaggtattgataaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacaaattcaagataaatatttgattggtttttccatctcactattaaaatgaagcataagaccctcaaattaggtttaaatgttttaacagtgaagttttatgggagagtacatccaaaaatacagagaaaatacatttatgtatttcatatcacacctttcctccaaggccatcatgacatcaaaactgatcccttttctttatccctaacttggattttgtaaagaattgtaacatcttttctgaaaccacaagtctacagtgtaaaaaatgtttcattcccaggtttctactggcaacattaaatgaagaccttatgaaacctggccgggcatggtagctcacacctataatcccagcactttgggagacagaggtgggtggatcacctgaagtcaggagttcgggaccagcctggccaacatggtgaaaccccacctttactaaaaatacaaaaattagccgggtgtggtagtgggcgcctgtaatcccagctactcaggaggctgaggcaggagaatcgcttaaacctgggaggcggagtttgcagtgagccaagatcgtgccattgcactccaacctgggcgaagagagtgaaattctgtctcaaaacaaacaaacaaacacacacacgcccttaagaacgcaatgaggataacatgttggcccttgtatttgagaaggcaacctggcttgactctgagctacagctccaagaaataaagacgatttgctcactggtcctagctctgacaataagcacctgcccagtgaagtctctggctgtgaaggtgagtgaggtgttctctccattccatccattctggagttggaattttccaaacactgctaaaggtgggggtgtgccaggaaaacaaaggaacacaacatggaccagccaagttccctctcttgccctcataagcagaacaaagtctcagcactccaggactggccgctatttgcctttcttagatgggagtgtaggaagagggagcataccaggccttagaatctgtcctcactagacatggaggaggagatgatgtaattttttttttaaataaaaagatatgcaatgcgcatgctgttgtgctatgagaagaatgtggaaattcacaagttgggcattgtttagctttgtatccctgtggctactgtgttcaactcagcctgaggctccatgaagacggtccttgagtctgacttccaagggcctgacagcctattggtgacagcctttacaatcactggtatctgaagctcaagcaagacagacaccaactaagtacccccagcagtaatttctcaaaaaacaattcagtaacatgcagactccatccttaacggcaatctgaggctctgctgtggtcaacaaataccactgacagtggcccggaccaccactccaattcccaaagacctatgggccccgatgacatgaaggtcactcagagcttaaaggcagagatgaatgcaatgaagatttccactgaaagatggcagagaaatgttctacccacactcacccaattgagatttgtggaattcaacagcccccaaacgttttaaaagcaaataattcagtatccattcatgcctttctccaaatgatttcaactcttcataaagtaatcataagttaaataaaataacatctctccttttgatactaacttcctatagcttagccgttataggcaaaatggcagtgtggtttaactgaatccacatttacagttgagaatactcctactccctgctgttacatcagtgtaagatgttttagttggcaatctaaaccctgctaattttcttacaactgtttttttttttttttttgagatggaatttcactcttgttgcccaggctagagtgcaatgtcgccatctcggctcactgcaacctccacctcccacattgaagtgattctccagcctcagcctctcaggtagctgggattacaggtgcgcaccaccatgcccggctaattctgtatttttagtggagatgaagtatcaccatattggccaggctggttttgaactcctaatctcaggtgatctgcctgcctcggcctcccaaagtattgggattacaggcatgagccaccatattaagagactttcaagaatgaaatgatccctgtgtaatttttacgattgagttccaactggctacaaagagaggaatgtatacaatagcatgcagaacagtctccgagaagttccgtggctacagaatgggggcatttctcacaccactctgtcagcttccttatccctgttacagagtgacctttttataacaagaagaactttttttttttttgacacagaggcttgctctatcacccaggctggagtacagtggtgcaatcttggctcactgcaacctccgcctcccggcttcaagtgattctcgggcctcagctgcctgagtagctgggattataagtgtgcaccaccatgtccggctaatttttgtattttttgtagaaacggggtttcaccatgttggccaggctggtcttgaactcctggcctcaagtgatccacctgcctcggcctcccaaagtgctgggattacaggtgtgatccactgcgccccacctataacaagaacttttattcatgcaacaaacattcctaggtcctctatcacatgcagcttctttgctaggtgatggggacacaatgctgaacaagatggtcccagccttcaaagagcctccaaagagcctccagttcagccaggaagacaaaaatgtacaagtaaataattacaaaaactgcaaaggtagaagcgactggaggctaaagggacccagagaataggctccactgttacagatatggagaaaacagtgaaatgtcacttccagaagaagataaagcttgagctgagactaaggcataggcaggtgagtgcttctcagcctttcagattttatggacctgtgacatccacactccaaaactctgcagagacagcatggggatgtcagctttaattttgccaagaggggcacttcagacaaaatttgtacgactgccaacacatcataaaaggacattattttaatacaaaaagtgaaaggggtacaaaactgcagcataaagaacattcctttagtttacgtaatatacatttagccttatgaaaatcttggtacactgtatttttattccatctcaccgtgttcaagtcaacattctgtcaccaggtaccccagggtcacagatgcacatttggaacctctgatctagatgacaaaggcagatctggagggcagtttctcacctctgcaaagatcaaagcaacagaccaggagagaaagaaatacaccaagggaagtactgagagggccgatggatcagcaaaggcctaaggccaggtaccatgggtcatgcctgtaatcacggcactttgggaggccaaaacaagagaatctattgaacccagttcaagaccagcccgggcgacacagtgagactctgtccctaaaaaatttaaaaattagccagccatggtggcacatgcccatagtcccagctactcaggaggctgacaccagaggatcacttcagcccagaagttagaggctgccgtgagccaagactgtgccaaagcactccagcctgggtgacagagcgagaccccatctctggaaaaaacaaacaaaaaaaagcagcttagaacacgtcaaggaaggtcagtgtattctgacccttcttgcaatggaagccacatcaccaacacacgcacgagcctaggacagaggcacccaaagaccaagcccgatgagttacttccgtagagaccagagaggtctggaaggcagtgcctggcagcagacagtcctcacccgctgccatgatgctaaaacctcctccaggacccaggcaccatctcagataaaagctcttcaaggacccaggcaccatctcagaagtgggtgagccgctgaggaaggaggaaatccatccttcagaggagagaagagcctcagataggaagcgtgaactgaccacacttaaaatcctcaaggagatatttatctgcaagcgactctttgaaaccaaaaaacactgagttatcttgaggttgccacattatatgttctctacaagtgaggtgaaatgaggatgtgtgaggcagttgggttataaagaaataaagttccatttggggtcacaatgtgaatgtgtaagtgtcccacctgcttccgtagttgagagactggctggggctggaagaaatggatccacccgagcggtatgaaggagctgggtttcatatgtgatattaagagttaaggtgctacgttaacaaccaacatttaacactgcaggggtagcgctttatcacaagagactttcgctcaggccacagtacatcagttcttcggatcccttatgaactcttccacctcaaaccagcatatactgttttgtatcacagctatacatttcagaaagaaaataaaagttgaatttttaaaaaagactctttcctagtacacttgacaagcattgtggagtgaggctgacctcattgctgaaaagcgatcggaagcttcaggacatcataagggctggtgagagaaagcgctgtgtaaacacagtgtttggcaaatccaaggactgccaaggaggggccaccgctccctgacaccctgtcaattccactgctccacgccaggccagcacagtttgtgaggccaggatgaggaacaggccacagcctccagcatgggtaaagataacgacatcagtgcacagctcttcaaagtccacagtgttcccacagtcatcctcccagtagacagtcccatgtgacagacaggtcacatgacagtcacattcccccatccctcctcctctgagatgctaaacctgatgtttccagaagttgagtaccttgctcaaaacacagagttaataaatagcagcaatggacattaaactctactccaatgtgtaatcttgatctatttccaccttccttctcacaataacgaaatcacctaaacacctggtaggtctgcacagctatggaccttatagccacctgatatgagaagcatacgtttatcaaggagctcctaaactgactcaggaactgggttacctgttacaagccaaaaatattcttcgcctcattttcctcatggacaaaaactgattcaacaatccatctcatagggtcgttttagagttaaataaaatttttggaaactttctaatacacaattgtacattgctactgttatgccaacaaccttgtaaaacaagccttattatcatcctcacttttctgatgaccaaagctcaatagtttattcatccagtcacgaagactttctggctgggcacagtggctcacactgtaatcccagcacttcgggaggccgaggcaggcggatcacctgagtaaggagttcaagaccagcctggccaacatggtgaaaccccacctgcactaaaaatacaaaaaattagctgggcgtggtggtgggtgcctgtaatcccagctactccggaggctgaagtaggagaatggctggaacccaggaggcagaggttgcagtgagccgagatcgtgcccttgcactccagcctgggcaacaagagcaaaactccatctcaaaaaaaaaaagacattctaaggtgatggacacattctgtatcttgattggtgtgatcgttacaccaatatgtatttgtcaaaactcatataattgcacacttaagccaggtgcactgcatttcatcacacttaatgttatctcaaaaattgtttcaaagatcatgtggtagtgaacagcagtgtgtattctgagacatattcatgaattcttattggaatctacagattttttccgcattctttttctgtaatctgcttgccaactaatccttcctacccaacagaaacccttaaatgttgacgatagctactagttaccgtttctgtctctttactcagaatttcatgttttactgttacatcctgaacatattcatctagaaccttccactgaagtaggtctctgtccacaacccagtagggtacgacagccacagactaaaccaccaccttgaaaagcaggctaggaaggatcatgtgccagctgcctgcagtcctaactcagccgacttctgagaatctcaactatatttctcaatctaagtcaacattccttcaacagtttattgaacaaaaataaaaagcacaattctaaatactcctcccagaggaaggaacaaaataaagcccttgctctcttagatatcacatcatattgtagatgattttcaaaattccatcagaaagtaacctttgtcatgaaaatcagtaaaaaagaacaagaggcaaaacagtaagtttcaggatagtactgggtccaaagtatttacttttatacaatgagctgtttgtatagaagtaaataattaaaagcaccatctacccccagggcttatcaaaggcactctcaaagactgtacagttatgctaaagaaatgatttgatgtacagactgtgcatgcttttagttgtctttttttttttttgagacggagtttcactcttattgcccaggctggaatgcaatggcacgatctcagctcaccacaacctccgcctcccaggttcaagcgattctcctgcctcagcctgaccagtagctaggattacaggaatgagccacctcacctggctacttttgtaattttagtagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgctagcaagagttctttaacagaaggtgactgtatatacacatttaactcacagcagcagcccaacgatagccaacctccaaccagggcctatttatacagtcctaaccctatatattccttagaagacaatttggaaatagagaactgatgacttttagggctaaaaatcatgactgatattcagctgaaactgtggttttgtgagggcattcgtctcttcccagttctgacactggcctcacctcctacttcagtttccatctgggattacctccatttcctccactaattacctgccgctcagtagcttacaataaggaaacagaattcaagatttctacttttaaaaaaagtttcaactgggcacggtggctcacacctgtaatcccagcactttgggaggttgaggcaggtggatcacaagatcaggaaatcaagaccatcctggctaacatggtgaagccccacctctaataaaaatacaaaaaattagccagacatgatggcacacacctgtagtcccagctactcgggaggctgaggtaggagaactgcttgaacccgggaggcagaggttgccatgagccgagatgaagccattgcactccagcctgggtgacagagcaagattccctttcaaaaaaaaaaaaaaagtttcaggaaaaaaaatagtagttgctatccagcatataagaccacagactgctaatctatgaagtgagatacaaaaaatctaattattcaaatgattgtttctatacagttctattaggacttattgcaaaaagcagtctgaaagctataaagtcctatgtaagtggaattcatgattgtaatgatctctaactgtcaatttttcacttgtgctactaatctgaatggcttacaacatttaacattcggctttacgttctgtgattagaaaatgtgaaaataaaccgtaattctcagctatgtcatttgaaattttacatatcataactactgcatgacttggcctggcacagtggcttactcctataatcccagcacttcgggaggccaaggcaggtggatcacttgaggtcaagagttcgagaccagcgtggcctacatggtgaaactccatctctatcaaaaatacaaaaattagccgggcatgatggcaggcacctgtaatcccagctacccaggaagctgaggcaggagaatcgcttgaatccgggaggtggaggttgcagtcagccggatcgtaccactgcactccaacctgggtgacaaagcaaactatcggtgggggcggggagaagttttatcccatttcagcaccaatgtatagaaaatcctggcaacagaaacttattacttccactcgcattaaaactagtcaaataacagcatcatactgggtgtgggaaatggaccggtacaagtccagtcccagttccataacttactcgccataagacaaaacatttatccaaatagttctggtccccagtctccttcagtataaaagaaagcactcatgacctgctctgcccaaccgcagggctgatgtgatcagttcttaatatcatatttacaatgtgcttgccacaaacatagggaattaatatttcactatgcttaaaagatgaaaatacaaaattgcttttatatttaaatactgtatattaatagtaacattttacaattgaaactctaaaatacaaatattctggactatgttacaggtgaaaaatcagaacagggaaccttagtactgtaatatccacaagtccaagattagttcaaagtgatgactcaattgtctttcgaatgtgctgactgatagcaaagaggcaacataatttacagactttaccaaagataaaagtatctacattgattttttgaaaacacagttcaaatggagtatcagcagctcactagacttaaactttcaagaaaaacaagaggtgacaaagctggagtctgagaataaacaatctccaatgtttgctacaaatcaattcctcctaaggaagagggaaagttatcagcctcctgagcctagaatttaactcccaaccgacagcaccagcagatccaagcaacacctccaaggctaagcagcagaaattaaatgaaacacctatctatgaatcagaagatttaatttaaaactagagactaaggaaggttattagcacccattgatcattttctatatacctggcacctgtgtcagaataaccccaggagacaaggtactacccccaccttccagcgtcctgatgagccaactggggagcaaaggtaatgaaatttcactcaaggtcacatggctaataggaaaatctcagacatgaacccaattttgcctgttaagtctgtgcactctctatgacattactgcaccaaatgtcctggatacccattacatttttccaattctataataaagtatgtccccagggtttcataatggatgtcatggtgggcaaaatctagctaaatggtgaaatacctctatttattatttgaaattcaataaaaacaggaggaaggagagaagaaaagcagtccctagcactgaaggatggagggctaatcattcaagatcaaaacaactcacaccatataaggagaaaatagttttcatttgattatatatctacaaggttatacatttttaaatgttcagcctaataagctgtaaccagaactttccaacaaaatagtcttatctgcaatataaaatggtttaggttttctcatagaaacagaaatgtaggatttttcttacctcccttttcattaactgaccctactcttttaaattcaaattaagagtaagtaaatccctttgcagaggtgccatcaaaaacactataaagcaacatcagaaggctgggcatggtggcttacgcctgtaatcccagcactttggaaggacaaggtggacagatcgcctgaggccaggagattgccaccagcctggccaacatggggaaattctgtctctaccaaaaatacaaaaattatccaggcgcggtggcgcatacctgtagtgccaggtactcagaaggctatggcatgagaatcacttaaacctgggaggcggaggttgcagtgagccgagatcacaccactgtcctccagcctgtgacacagcaagactctgtctcaaaaaaaatctgaaagcaaaacaattttttaacccttaaacagaaaatacttcttcacagcattaaatcaagttcaataaccagcaagtctagagaactattgaaaagttttacataaatgcaaaactactctgaaacacaaatcttattagatgtaatgagaaaaaagaatcctagactgcaaagttatctgaattcctaagttgtacatacatttttctctaaacagaaaacagcccaagtccctagtcaaaagaaattgtcaacttgcgattgtctgcacgaatagggaatgtcataaatcatgagtggaatcaattacgtacatgtatttgcacatgggtatgccagatgttctcaaactgactcttcataataaaacagtaactcagaagcatcaggaaacttggcaccttccagctctgatgctctgctcccaaagccatggccgttcagtcggacacaagactgagggtaaactaccttccctctgcttgctgagtatgaaacaatggatgagggggtgagggcaagaggagagggcaaggagcaaggcacagaaaagcaataaggaaattaatacctgtggtttaaaagaccttccagtagctgtgactatctgacaaaagaatttcaaattcccatgccatcagagctctagatgatttattccagaccacatctgggagaaataattataaaagtaaaaatgtacccagcatccgaacatttagaccctatccttaaggagcttacaagatgtagcaaaaatatactggaaaaggtaactaaagattctcattgagagaaattaagagacgccaaagagtacagtgctaagtattttccttcttaatccttttggtgagaaggaaaagggtaagcatgattaatgacaaggatgctttatataaccaagaatgtcaatacaacctacgtgaccaaactttggtcaagtcagcaggtggaatttttaatgcaaagcccaacgttaacaacctgggagaatatttcgaacaacacaaacacttactaacatctccaaaactgcacttttcacaatgattggggtttctctgactcctccaagaaaagaggtcaaattcttttttttctcttctacctcagtgtttggcccatagaaagtgctcaaaaatggctgaggctgaggaaaaccaaacacaggccgggcacagtggctcacgtctgtagtcccagcactttgggaggccaaggccggtggatcacctgaggtcaggagttcgagaccagcctgatcaacatggtgaaaccctgtctctactaaaaataaaaaatgaagacgggcgtggtggtgcatgcctgtaatcccagctactcagaaagctgaggcaggagaatcgcttgaacccaggaggcggacactgcagtgagccaagatcacgccactgcactccagcctgggcaacaagagcaaaactctgtctcaaaaaaaaagataaaagaaaaaaaaatcaaacataatattctaacagcaaggatttttactcatgctttttatttatcattttacatgaaatataagcctaactatacactacgtataaatgacttggttctgtatgtggggcctagattggggatctaatacaacacgtgaatttttcttggtagctaggtcttggcatggctcagcccttttaaatccatttctcattctccaatatccttctaccctatcctgacccaccagcaaggaggacttctgcaatcctcacttcaattaaagcctgttggcttagggtcacagtaataagcaaatatggttcaattctgtaatttgattaacaacgaaatgattaacagtatagcagtttacagtataataaaaaataagattttaacagtgcaaggtgacttaatcagaattctgggaaatatgactcaaccaccttgacacagaggtcaggggaagggggtaggtctatgtttcaatgtcatctcagaaactgctcatatctatgctggcttctattttcattccgtaaagctagccaagggagctatgttttacgaggacatgcagtttcaacttcgtatcattcatagctaacaatcatgcaaaaatctacaaaataaacattaaggaaaataaatttcttatttgtcactgaacactgctgaatacctcctatgaactgcttatctgaaataaggtgaagaaatattgattcttttcatccagattggtatatgtgtaaataacacctgagttaaatattaccatgtttccaatgtacaaaaagcataaaagataagctaactacccaacagtcaagacttaatgaacactgtcacaaacattatttacacaagaatgtatgttacgcctcttcttcctagtctcctgataagtatgagtctttcccaagattcccttttcaatgtcattttaggacacaaaatgtccttaaatgttttagttaacagtagaagatcagaataattatatttgattagtcctcaaatttaaatactaattttcttttcttctgcatcatgcttaagacacaatttacttataaggtacacatttatgcatttaaaagaataaggtcatttaatggtttaaaaacctcttccaatacatcttacctgaaagactgatccattcctagtctgttcttccctttagatgagttcacactgtgtcctagcaataaagcttctaggttagaatgagggtaaaatgtgtgtttttcttacttttatttatgtagctaatgtgtatacaagaatattccttttattcctttttagacagagtcttactctgtcacccaggctagagggcagtgatgcgatctcggctcactgcaacctccgcctcccgggttcaagtgattctcctgcctcagcctcccacgtagcggggatataagcacccaccaccacaccagctacttttgtatttttagtagagtcgggtttcaccatgttagccaagctggtctcaaactcctgacctcaggtgatccacctgccttggcctcccaaattgctgggattacaggtgtgagccactgagccaggcccaagaacattctttttttctgtttttcttttggagacaaagtctcactctgttggccaggctggagggcagtggagcgatctcagctcactgcaacctccgcctcctggattcaaggaattctcctgcctcagcctcctgagtagctgggattacaggcgcccaccaccacacccagctaattttttgtatttttagtagagatggggtttcactatgttggccagggtagtctagaactcctgacctgaagtgatccgcttggcttggcctcccaaagtgctgggattacaatgagccaccacgcccagccccaagaacattcttactttagatatgggcctgctagcaagatttaaatgcagtttatctttgaataaatacatttttattactttacaatatacagcttgaagtctaaactttaatgaacaaagttattttgtaatcaagatttatatgcaaatacgtacttctaaagtacctgaaagctatttacttaagtgaagcacttccaagttcgaccttgttcacactctaaacttgttgagaaaacccaccctttcttccttgattgtgtaacatttatatatcagagcaatcacaagttgccaatctgcttctagggtatgaaaaggaagttttatcttatgtatccacatggcaaagagcccccaaatctgtcacctccaaaatggaagtctcttttaccatttctaaggccaagtgagcaagaaaaagtcatgattaatgtcatcatggaaaattgccccatatccaagagtaaattcaaagattactgagggatttttctctaagaaaataaataaataaccatcatcagggcaatcatctacaaaacttggtttagaaataaatttttaggccggacttttaggccagacacagcggctcacgcttgtaatcccagcatttgggaggctgacgtaggcaatcacttgaggtcaggaattcgagaccaagttggccaacatggtgaaaccctgtctccactaaaaatacaaaaattagccaggcatggtggcgcacacctgtaatcccagctactcaggaggctgaggcaggagaatcacttgaacctgagaggtgggggttgcagtgagctgagatcgcacgcaccactgcactccaacctgggccacagagtgagactccatctcaaaataaatttttaggctgagggcggtggctcatgcctctaatcctagcactctgggaggctgaagtgggaggatttgcttgagcccagcagttcaaatccagcctgggcaacatggcaaaaccttgtctctacaaaaaatacaaaaattagccaggcatggcggcacatgactgtagtcccagatactcaggaggctgaggcgggaggatagcttgagcctgggacgtgaaggctgcagtaagctatgatcatgctactgtattccagcctgggtgacacagcaatatcccgtctcaaaaaataaaataaaataaaataaaataaaaagttagaagaaattacaagtcaaattcaactcctggttatactggaccatccaaaaccaggtataaagtctccctggtcaaagtaggcttttcggggccagatttcaagctagctgagttcataccatcccatctagtccttcatttcctgtgggtgggatcgctcatcctccttctcaggaggccacagtcaccactgtatccgctgctaagtggtcacctccctccggggcctgccttcttccagagaaagtctgaggccatttttaagtgcccctaagcacgcagatcctgaactccaatttcatccttatggctcaaatatggtcctatcgcttactcttacgctctaagcttggggaataaaagggactcaggctctcatggagaacacacttcctttagtgaggactttcagggtatattcaagctttcacaacacagagaaagaacccaactttgagatatcaggaagacgtgttcccccgcccccccaaataaatactttgctgagtagcagtattggaaattaatccaggaaattttttaactacgtatgcagtacatttgtctggacatcaacaagtccgtatgaaaccacaataatgactataaaaagaagaatctggcaaaatgatactacaaatagattactgacaataaatggagtgtgagcctactttgtataatcacagaataacagatctgaaaaacattcagtcttagggatttaaaactttctgctctgatttcaaaggatgttgttcctaatagtatataccaggcccagtggcttctcatcaacaaatgcaattagttttgcaacagtctctaacccaagatatggaagttcttgcaatgaatttgaaaagattctaatttagaatttggggaattttttttttttaagatggagttttgccctgttgcccaggctggagtgcactggagtgatctcggctcactgcaacctccacctcccgggttcaagcgcttctcctgcctcagcgtcccaagtagctgagattacagatccatgccaacacaattgactaattttttgtatctttagtagagacggggtttcaccatgttgcccaggctggtctcgaacccctgacctcctgatccgcccgccttggcttcccaaagtgctgggattagaggcgtgagccaccgcacccggctggaaaattttttttaaatcttctaccacagtcacatatagttctgaagctacgatttagaagtgttaaaaattctgttttgagaaagtcaacagatttatcaacattaaagaaatttgtgtatgtcaaaactactgtaaatatataaagcaaagataaaatgggaaaagtatctgcaatatgaatggcaaagatttactatcaatccataaaaggctcttatgaattaatggaaaaatactaatatcccaggagaaaaatctggcactacatcaaatttcaaaatggaaaacaactagatttctttggtgttcaaatcatctgtaatcaaagaaattgaagtttaaatatagagaaagcactgttcacctataaacctgggaagaattttttttttttccctttaaggatgattctacatgttgacaagaatacggtaacaccagtattctcacagagagctggtgggaacataatttggttaaacattttttggaaagcaaatggtcaatatgtatgaggagatcttccaaccatcaactgtatttcaagggcactaaggatattaaccctgcacataaagttttaaaaacgtatttgttgcaaaagtatatttagtaagtggaaataaatgaaaaccagtttgatacatctatgtaatgtaatattaagtagccactaagatttctgaagatttcatgacatggaaaatttttcatgatacattaatcaggaaaaaacctccacgcaatagtatatttagataaactatataactataaaaaatttttctatatattaacaagtattttcttaaatattaactgtgattatctttgctgaaattgcttaactcacttttctcaatctacctatttttatacagcaagcacggattacttttgaaatcaaaacaaacagggttaacagaacagggctattaagtaacaggctttttaaatgcttgagtgtaataactgcaggttagtttccaaaaaatataagatattatctagaatcttataatcctattatactccaaaatgtaaccttgacttattgacataattaaaaggtcttgttccaagcatgattttctaccaagcagatttaccaagaattattttctcttcataaacctgattttaaaaagaacaggtgaaaaaacgtggtgcaagttacataaataactacatattattttaaactaaattccacttctaaggttttttagctttggttttaaggataagcatgtagttctaatcttttctttgtatagctttcctaatggaatatattgcctatgaaaaaaaaaaaatctgtaacagcactttctacactgtaaagcactgtactaacaggacatcaccattttaagttgtgtatcatttcctgccctaaccatccctgaaaaagcaaactgtctacagaattgcaattccgtttatgcaattccttttaaagttgtccatgcactgttatcttgtatataccctccttaaagaggtcactggttcccaggaagcaatgactctcttttttaatcccctccctcctgcattgcctcccttcctcctgaaattcactggtaacacccctactcccaccctccagccccagcgctgtgatttagtgatgattgactttcgatcacctgcacctggcaaaacttgaaagcttccacgcaccgttttgcctaagactttggtttcattgaaacaaacaaaacacactggatttcctttcttagaacactgactacttcaaacaaacagtatttaacagagtatgtgtaactacgcaggctaaatgaattaacctcttccttcctagtcccaaattactccaagtcaaaaatcaacaaacaacttggtagaaaggagtacgtcttcaaaaaagaacaaaaacgttcctcagtgaacacctaagtccactaagcactatagagtagtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgcccccttt

SEQ ID NO: 2552 - DNA, 157125 bp, Homo sapiens; identical to SEQ ID NO: 2551

SEQ ID NO: 2553 - DNA, 31149 bp, Homo sapiens
attaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaatt

SEQ ID NO: 2554 - DNA, 31015 bp, Homo sapiens
attaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcatt

SEQ ID NO: 2555 - DNA, 31149 bp, Homo sapiens; identical to SEQ ID NO: 2553

SEQ ID NO: 2556 - DNA, 31015 bp, Homo sapiens; identical to SEQ ID NO: 2554
